(12) United States Patent
Foster et al.

(10) Patent No.: US 10,801,046 B2
(45) Date of Patent: Oct. 13, 2020

(54) METHODS AND MATERIALS FOR BIOSYNTHESIZING MULTIFUNCTIONAL, MULTIVARIATE MOLECULES VIA CARBON CHAIN MODIFICATION

(71) Applicant: INVISTA NORTH AMERICA S.A.R.L., Wilmington, DE (US)

(72) Inventors: Alexander Brett Foster, Hutton Rudby (GB); Stephen Thomas Cartman, Eaglescliffe (GB); Jonathan Kennedy, Stokesley (GB); William Joseph Simmons, Washington, DC (US)

(73) Assignee: INVISTA North America S.a.r.l., Wilmington, DE (US)

( * ) Notice: Subject to any disclaimer, the term of this patent is extended or adjusted under 35 U.S.C. 154(b) by 29 days.

(21) Appl. No.: 15/659,505

(22) Filed: Jul. 25, 2017

(65) Prior Publication Data

US 2018/0023103 A1 Jan. 25, 2018

Related U.S. Application Data

(60) Provisional application No. 62/366,539, filed on Jul. 25, 2016, provisional application No. 62/527,415, filed on Jun. 30, 2017.

(51) Int. Cl.

| | | |
|---|---|---|
| *C12P 7/62* | (2006.01) |
| *C12P 7/42* | (2006.01) |
| *C12N 15/09* | (2006.01) |
| *C12P 7/64* | (2006.01) |
| *C12N 15/52* | (2006.01) |
| *C12P 13/00* | (2006.01) |
| *C12P 7/24* | (2006.01) |
| *C12P 7/40* | (2006.01) |
| *C07C 47/12* | (2006.01) |
| *C07C 47/19* | (2006.01) |
| *C07C 55/16* | (2006.01) |
| *C07C 59/147* | (2006.01) |
| *C07C 223/02* | (2006.01) |
| *C07C 225/06* | (2006.01) |
| *C07C 229/08* | (2006.01) |
| *C12N 9/04* | (2006.01) |
| *C12N 9/10* | (2006.01) |
| *C12N 9/16* | (2006.01) |
| *C12N 9/88* | (2006.01) |
| *C12P 7/18* | (2006.01) |
| *C12P 7/44* | (2006.01) |

(52) U.S. Cl.
CPC .............. *C12P 7/62* (2013.01); *C07C 47/12* (2013.01); *C07C 47/19* (2013.01); *C07C 55/16* (2013.01); *C07C 59/147* (2013.01); *C07C 223/02* (2013.01); *C07C 225/06* (2013.01); *C07C 229/08* (2013.01); *C12N 9/0006* (2013.01); *C12N 9/1096* (2013.01); *C12N 9/16* (2013.01); *C12N 9/88* (2013.01); *C12N 15/09* (2013.01); *C12N 15/52* (2013.01); *C12P 7/18* (2013.01); *C12P 7/24* (2013.01); *C12P 7/40* (2013.01); *C12P 7/42* (2013.01); *C12P 7/44* (2013.01); *C12P 7/625* (2013.01); *C12P 7/6409* (2013.01); *C12P 13/001* (2013.01); *C12P 13/005* (2013.01); *C12Y 101/01035* (2013.01); *C12Y 101/01061* (2013.01); *C12Y 101/01258* (2013.01); *C12Y 301/02* (2013.01); *C12Y 402/01017* (2013.01)

(58) Field of Classification Search
None
See application file for complete search history.

(56) References Cited

U.S. PATENT DOCUMENTS

| | | | | |
|---|---|---|---|---|
| 9,580,731 B2 * | 2/2017 | Botes | .......................... | C12P 7/18 |
| 9,617,572 B2 * | 4/2017 | Botes | .......................... | C12P 7/18 |
| 9,637,764 B2 * | 5/2017 | Botes | .......................... | C12P 7/18 |
| 9,790,525 B2 * | 10/2017 | Conradie | .................. | C12P 7/18 |

(Continued)

FOREIGN PATENT DOCUMENTS

| | | |
|---|---|---|
| EP | 0 955 375 A2 | 11/1999 |
| EP | 2 647 718 A2 | 10/2013 |

(Continued)

OTHER PUBLICATIONS

UNIPROTKB, "Pyruvate Transaminase", Accession No. F2XBU9, May 31, 2011, 3 pages.

(Continued)

*Primary Examiner* — Iqbal H Chowdhury
(74) *Attorney, Agent, or Firm* — Invista North America S.A.R.L.

(57) ABSTRACT

This document describes biochemical pathways for producing a difunctional product having an odd number of carbon atoms in vitro or in a recombinant host, or salts or derivatives thereof, by forming two terminal functional groups selected from carboxyl, amine, formyl, and hydroxyl groups in an aliphatic carbon chain backbone having an odd number of carbon atoms synthesized from (i) acetyl-CoA and propanedioyl-CoA via one or more cycles of methyl ester shielded carbon chain elongation or (ii) propanedioyl-[acp] via one or more cycles of methyl ester shielded carbon chain elongation. The biochemical pathways and metabolic engineering and cultivation strategies described herein rely on enzymes or homologs accepting methyl ester shielded aliphatic carbon chain backbones and maintaining the methyl ester shield for at least one further enzymatic step following one or more cycles of methyl ester shielded carbon chain elongation.

30 Claims, 61 Drawing Sheets

Specification includes a Sequence Listing.

(56) References Cited

U.S. PATENT DOCUMENTS

| | | | |
|---|---|---|---|
| 9,920,336 B2* | 3/2018 | Pearlman | C12P 7/18 |
| 2007/0118916 A1 | 5/2007 | Puzio et al. | |
| 2014/0186904 A1* | 7/2014 | Botes | C12P 7/42 |
| | | | 435/128 |

FOREIGN PATENT DOCUMENTS

| | | |
|---|---|---|
| WO | 2014/015278 A1 | 1/2014 |
| WO | WO 2014/105794 A2 * | 7/2014 |
| WO | 2016/106247 A1 | 6/2016 |

OTHER PUBLICATIONS

UNIPROTKB, "S-Adenosylmethionine Synthase", Accession No. P0A817, Jan. 23, 2007, 9 pages.

UNIPROTKB, "Short-Chain-Enoyl-CoA Hydratase", Accession No. P52046, Oct. 1, 1996, 4 pages.

UNIPROTKB, "Similar to *Saccharomyces cerevisiae* YER015W FAA2 Medium Chain Fatty Acyl-CoA Synthetase", Accession No. A0A0J9XGX9, Oct. 14, 2015, 4 pages.

UNIPROTKB, "Taurine-Pyruvate Aminotransferase", Accession No. A0A0H5D6A2, Oct. 14, 2015, 3 pages.

UNIPROTKB, "Taurine-Pyruvate Aminotransferase", Accession No. B9L0N2, Mar. 24, 2009, 3 pages.

UNIPROTKB, "Thioester Reductase Domain Protein", Accession No. D6ZDT1, Aug. 10, 2010, 4 pages.

UNIPROTKB, "Thioester Reductase Domain-Containing Protein", Accession No. E5XUS9, Mar. 8, 2011, 5 pages.

UNIPROTKB, "Thioester Reductase-Like Protein", Accession No. L0IYJ8, Mar. 6, 2013, 5 pages.

UNIPROTKB, "Thioesterase 1/Protease 1/Lysophospholipase L1", Accession No. P0ADA2, Dec. 6, 2005, 5 pages.

UNIPROTKB, "Trans-2-Enoyl-CoA Reductase [NADH]", Accession No. Q73Q47, May 14, 2014, 7 pages.

UNIPROTKB, "Trans-2-Enoyl-CoA Reductase", Accession No. A0QUC2, Jan. 9, 2007, 3 pages.

UNIPROTKB, "Trans-2-Enoyl-CoA Reductase, Mitochondrial", Accession No. Q5EU90, Feb. 19, 2014, 6 pages.

UNIPROTKB, "Transketolase 1", Accession No. P27302, Oct. 11, 2004, 7 pages.

UNIPROTKB, "Translation Elongation Initiation Factor 4C", Accession No. Q3IWE9, Oct. 25, 2005, 3 pages.

UNIPROTKB, "Triosephosphate Isomerase", Accession No. P0A858, Jun. 7, 2005, 7 pages.

UNIPROTKB, "Uncharacterized Acyl-CoA Thioester Hydrolase HI_0827", Accession No. P44886, Nov. 1, 1995, 4 pages.

UNIPROTKB, "Uncharacterized Acyl-CoA Thioester Hydrolase YkhA", Accession No. P49851, Mar. 15, 2004, 4 pages.

UNIPROTKB, "Uncharacterized Protein", Accession No. A0A034UK40, Jul. 9, 2014, 5 pages.

UNIPROTKB, "Uncharacterized Protein", Accession No. A0A0B3WUQ1, Mar. 4, 2015, 3 pages.

UNIPROTKB, "Uncharacterized Protein", Accession No. A0A0C7BIS0, Apr. 29, 2015, 3 pages.

UNIPROTKB, "Uncharacterized Protein", Accession No. A0A0D3V4E9, May 27, 2015, 3 pages.

UNIPROTKB, "Uncharacterized Protein", Accession No. A0A0F7JXA5, Jul. 22, 2015, 3 pages.

UNIPROTKB, "Uncharacterized Protein", Accession No. A0A0F9UFF8, Jul. 22, 2015, 3 pages.

UNIPROTKB, "Uncharacterized Protein", Accession No. A0A0F9W7B7, Jul. 22, 2015, 3 pages.

UNIPROTKB, "Uncharacterized Protein", Accession No. A0A0G4ID64, Sep. 16, 2015, 3 pages.

UNIPROTKB, "Uncharacterized protein", Accession No. A0A0H5CAG1, Oct. 14, 2015, 3 pages.

UNIPROTKB, "Uncharacterized Protein", Accession No. A0A0M3J210, Nov. 11, 2015, 3 pages.

UNIPROTKB, "Uncharacterized Protein", Accession No. A3U3W9, Apr. 3, 2007, 3 pages.

UNIPROTKB, "Uncharacterized Protein", Accession No. D0BKN0, Nov. 24, 2009, 3 pages.

UNIPROTKB, "Uncharacterized Protein", Accession No. G3BAK1, Nov. 16, 2011, 3 pages.

UNIPROTKB, "Uncharacterized Protein", Accession No. G4YTV4, Dec. 14, 2011, 4 pages.

UNIPROTKB, "Uncharacterized Protein", Accession No. K5D7V3, Jan. 9, 2013, 3 pages.

UNIPROTKB, "Uncharacterized Protein", Accession No. Q6MKA8, Jul. 5, 2004, 3 pages.

UNIPROTKB, "Uncharacterized Protein", Accession No. R6Q7V8, Jul. 24, 2013, 2 pages.

UNIPROTKB, "Uncharacterized Protein", Accession No. T1EG09, Oct. 16, 2013, 3 pages.

UNIPROTKB, "Uncharacterized Protein", Accession No. W3XHR4, Mar. 19, 2014, 3 pages.

UNIPROTKB, "Uncharacterized Protein", Accession No. W6MHS7, Apr. 16, 2014, 3 pages.

Venkitasubramanian et al., "Aldehyde Oxidoreductase as a Biocatalyst: Reductions of Vanillic Acid", Enzyme and Microbial Technology, vol. 42, No. 2, Jan. 2008, pp. 130-137.

Wang et al., "Reversed-Phase High-Performance Liquid Chromatography Procedure for the Simultaneous Determination of S-Adenosyl-L-Methionine and S-Adenosyl-L-Homocysteine in Mouse Liver and the Effect of Methionine on Their Concentrations", Journal of Chromatography B: Biomedical Sciences and Applications, vol. 762, Issue 1, Oct. 5, 2001, pp. 59-65.

Wee et al., "Biotechnological Production of Lactic Acid and Its Recent Applications", Food Technology and Biotechnology, vol. 44, No. 2, 2006, pp. 163-172.

Woolridge et al., "Efflux of the Natural Polyamine Spermidine Facilitated by the Bacillus Subtilis Multidrug Transporter Blt", The Journal of Biological Chemistry, vol. 272, No. 14, Apr. 4, 1997, pp. 8864-8866.

Yang et al., "Value-Added Uses for Crude Glycerol—a Byproduct of Biodiesel Production", Biotechnology for Biofuels, vol. 5, No. 13, 2012, pp. 1-10.

Yonaha et al., "4-Aminobutyrate : 2-Oxoglutarate Aminotransferase of Streptomyces Griseus : Purification and Properties", European Journal of Biochemistry, vol. 146, Jan. 1985, pp. 101-106.

Yurimoto et al., "Yeast Methylotrophy: Metabolism, Gene Regulation and Peroxisome Homeostasis", International Journal of Microbiology, Article ID 101298, Hindawi Publishing Corporation, doi:10.1155/2011/101298, 2011, pp. 1-8.

Zhuang et al., "Divergence of Function in the Hot Dog Fold Enzyme Superfamily: The Bacterial Thioesterase YciA†", Biochemistry, vol. 47, No. 9, Feb. 2, 2008, pp. 2789-2796.

UniProtKB, "acyl-ACP thioesterase [Lactobacillus delbrueckii]", Accession No. WP_011678490.1, May 25, 2013, 2 pages.

GenBank, "acyl-ACP thioesterase [Clostridium perfringens]", Accession No. WP_011591187.1, May 16, 2013, 1 page.

GenBank, "hypothetical prtien [Treponema denticola]", Accession No. WP_002688506.1, May 12, 2013, 1 page.

GenBank, "oxidoreductase [*Mycobacterium avium*]", Accession No. WP_019730046.1, Jun. 29, 2013, 2 pages.

GenBank, "Segniliparus rotundus carboxylate reductase", Accession No. D6Z860.

Adkins, Jake, et al. "Engineering microbial chemical factories to produce renewable 'biomonomers'" Synthetic Biology Applications in Industrial Microbiology (2014): 31.

UNIPROTKB, "6-Hydroxyhexanoate Dehydrogenase", Accession No. Q7WVD0, Oct. 1, 2003, 3 pages.

UNIPROTKB, "6-Oxohexanoate Dehydrogenase", Accession No. Q6RXW0, Jul. 5, 2004, 3 pages.

UNIPROTKB, "6-Oxohexanoate Dehydrogenase", Accession No. Q9R2F4, May 1, 2000, 3 pages.

UNIPROTKB, "6-Phosphogluconate Dehydrogenase, Decarboxylating", Accession No. P52209, Jan. 23, 2007, 8 pages.

UNIPROTKB, "Acetoacetyl-CoA Reductase", Accession No. P14697, Apr. 1, 1990, 5 pages.

(56) References Cited

OTHER PUBLICATIONS

UNIPROTKB, "Acetyl-CoA Synthetase-Like Protein", Accession No. A0A0H2RRC5, Sep. 16, 2015, 4 pages.
UNIPROTKB, "Acetyl-Coenzyme A Synthetase", Accession No. P27550, Oct. 1, 1993, 6 pages.
UNIPROTKB, "Acetylornithine Aminotransferase", Accession No. R5HDC3, Jul. 24, 2013, 5 pages.
UNIPROTKB, "Acetylpolyamine Amidohydrolase 1", Accession No. Q9I3T5, Mar. 1, 2001, 5 pages.
UNIPROTKB, "Acetylpolyamine Amidohydrolase 2", Accession No. Q9I6H0, Mar. 1, 2001, 5 pages.
UNIPROTKB, "Acetylpolyamine Amidohydrolase", Accession No. Q3JUN4, Nov. 8, 2005, 4 pages.
UNIPROTKB, "Acetylpolyamine Amidohydrolase", Accession No. Q48935, Nov. 1, 1996, 5 pages.
UNIPROTKB, "Acyl-[Acyl-Carrier Protein] Thioesterase", Accession No. F9ULU3, Oct. 19, 2011, 3 pages.
UNIPROTKB, "Acyl-[Acyl-Carrier-Protein] Hydrolase", Accession No. Q39514, Nov. 1, 1996, 4 pages.
UNIPROTKB, "Acyl-[Acyl-Carrier-Protein] Hydrolase", Accession No. Q39554, Nov. 1, 1996, 4 pages.
UNIPROTKB, "Acyl-[Acyl-Carrier-Protein] Hydrolase", Accession No. Q41634, Nov. 1, 1996, 4 pages.
UNIPROTKB, "Acyl-ACP Thioesterase Family Protein", Accession No. A0A0C1QZB7, Apr. 1, 2015, 3 pages.
UNIPROTKB, "Acyl-ACP Thioesterase", Accession No. A0A0B4Y4H4, Apr. 1, 2015, 3 pages.
UNIPROTKB, "Acyl-ACP Thioesterase", Accession No. A0A0L8EW05, Nov. 11, 2015, 2 pages.
UNIPROTKB, "Acyl-ACP Thioesterase", Accession No. A0A0M2NEM6, Nov. 11, 2015, 3 pages.
UNIPROTKB, "Acyl-ACP Thioesterase", Accession No. A3DJY9, Mar. 20, 2007, 3 pages.
UNIPROTKB, "Acyl-ACP Thioesterase", Accession No. B1ZXQ1, May 20, 2008, 3 pages.
UNIPROTKB, "Acyl-ACP Thioesterase", Accession No. B8I625, Mar. 3, 2009, 3 pages.
UNIPROTKB, "Acyl-ACP Thioesterase", Accession No. C7ML86, Oct. 13, 2009, 3 pages.
UNIPROTKB, "Acyl-ACP Thioesterase", Accession No. D4YGM6, Jun. 15, 2010, 3 pages.
UNIPROTKB, "Acyl-ACP Thioesterase", Accession No. D5XAN2, Jul. 13, 2010, 3 pages.
UNIPROTKB, "Acyl-ACP Thioesterase", Accession No. D6E2B1, Jul. 13, 2010, 3 pages.
UNIPROTKB, "Acyl-ACP Thioesterase", Accession No. E1RAP4, Nov. 30, 2010, 3 pages.
UNIPROTKB, "Acyl-ACP Thioesterase", Accession No. E4L0C9, Feb. 8, 2011, 3 pages.
UNIPROTKB, "Acyl-ACP Thioesterase", Accession No. G4HNN3, Dec. 14, 2011, 3 pages.
UNIPROTKB, "Acyl-ACP Thioesterase", Accession No. I7KI30, Oct. 3, 2012, 3 pages.
UNIPROTKB, "Acyl-ACP Thioesterase", Accession No. M1WJV0, May 1, 2013, 3 pages.
UNIPROTKB, "Acyl-ACP Thioesterase", Accession No. M1Z1V0, May 1, 2013, 2 pages.
UNIPROTKB, "Acyl-ACP Thioesterase", Accession No. Q03SR8, Nov. 14, 2006, 3 pages.
UNIPROTKB, "Acyl-ACP Thioesterase", Accession No. R5FQ35, Jul. 24, 2013, 2 pages.
UNIPROTKB, "Acyl-ACP Thioesterase", Accession No. R6RDZ9, Jul. 24, 2013, 2 pages.
UNIPROTKB, "Acyl-ACP Thioesterase", Accession No. U2CXE7, Nov. 13, 2013, 3 pages.
UNIPROTKB, "Acyl-ACP Thioesterase", AccessionNo. G7V8P3, Jan. 25, 2012, 3 pages.
UNIPROTKB, "Acyl-Acyl Carrier Protein Thioesterase", Accession No. A0PXB0, Jan. 9, 2007, 3 pages.
UNIPROTKB, "Acyl-Acyl Carrier Protein Thioesterase", Accession No. C5WH65, Sep. 1, 2009, 3 pages.
UNIPROTKB, "Acyl-Acyl Carrier Protein Thioesterase", Accession No. F7R2D3, Sep. 21, 2011, 3 pages.
UNIPROTKB, "Acyl-CoA Synthetase", Accession No. A0A0F4ES51, Jun. 24, 2015, 4 pages.
UNIPROTKB, "Acyl-CoA Thioester Hydrolase YbgC", Accession No. P0A8Z3, Jun. 21, 2005, 5 pages.
UNIPROTKB, "Acyl-CoA Thioesterase I", Accession No. A4VL40, May 29, 2007, 3 pages.
UNIPROTKB, "Acyl-CoA Thioesterase I", Accession No. D2TLW8, Mar. 2, 2010, 3 pages.
UNIPROTKB, "Acyl-CoA Thioesterase I", Accession No. I2BBI6, Jul. 11, 2012, 3 pages.
UNIPROTKB, "Acyl-CoA Thioesterase I", Accession No. L1M6X0, Mar. 6, 2013, 3 pages.
UNIPROTKB, "Acyl-CoA Thioesterase YciA", Accession No. B1LH39, Apr. 29, 2008, 3 pages.
UNIPROTKB, "Acyl-CoA Thioesterase", Accession No. H2FZ27, Mar. 21, 2012, 3 pages.
UNIPROTKB, "Acyl-Coenzyme A Thioesterase 13", Accession No. Q9NPJ3, Oct. 1, 2000, 7 pages.
UNIPROTKB, "Glutaconate CoA-Transferase Subunit A", Accession No. Q59111, Jan. 23, 2007, 5 pages.
UNIPROTKB, "Glutaconate CoA-Transferase Subunit B", Accession No. Q59112, Jan. 23, 2007, 5 pages.
UNIPROTKB, "Glutamate Dehydrogenase 1, Mitochondrial", Accession No. P00366, Sep. 13, 2004, 9 pages.
UNIPROTKB, "Glutamate Dehydrogenase 1, Mitochondrial", Accession No. P00367, Jan. 1, 1990, 12 pages.
UNIPROTKB, "Glutaryl-CoA Dehydrogenase (EC 1.3.99.7)", Accession No. A0A0K3B4X3, Nov. 11, 2015, 3 pages.
UNIPROTKB, "Glyceraldehyde-3-Phosphate Dehydrogenase A", Accession No. P0A9B2, Jan. 23, 2007, 8 pages.
UNIPROTKB, "L-Lactate Dehydrogenase", Accession No. P00344, Jan. 1, 1988, 5 pages.
UNIPROTKB, "L-Lysine 6-Transaminase", Accession No. D7VKX2, Oct. 5, 2010, 3 pages.
UNIPROTKB, "Long Chain Acyl-CoA Synthetase 7, Peroxisomal", Accession No. A0A087SHC7, Oct. 29, 2014, 4 pages.
UNIPROTKB, "Long Chain Acyl-Synthetase Peroxisomal-Like", Accession No. A0A068SDQ8, Oct. 1, 2014, 3 pages.
UNIPROTKB, "Long-Chain Fatty Acid CoA Ligase, Putative", Accession No. Q4N8F1, Aug. 2, 2005, 3 pages.
UNIPROTKB, "Long-Chain-Fatty-Acid-CoA Ligase 5", Accession No. F1KXI1, May 3, 2011, 3 pages.
UNIPROTKB, "Long-Chain-Fatty-Acid-CoA Ligase", Accession No. A0A0K1PNT5, Nov. 11, 2015, 3 pages.
UNIPROTKB, "Lysine Acetyltransferase", Accession No. P41929, Oct. 11, 2004, 4 pages.
UNIPROTKB, "Lysophospholipase L1", Accession No. A4A3N9, Apr. 3, 2007, 3 pages.
UNIPROTKB, "Lysophospholipase L1-Like Esterase", Accession No. A0A0F7M706, Jul. 22, 2015, 3 pages.
UNIPROTKB, "Lysophospholipase", Accession No. A0A075P0V4, Oct. 29, 2014, 3 pages.
UNIPROTKB, "Lysophospholipase", Accession No. E1SPF5, Nov. 30, 2010, 4 pages.
UNIPROTKB, "Malonyl-[Acyl-Carrier Protein] O-Methyltransferase", Accession No. P36571, Jun. 1, 1994, 4 pages.
UNIPROTKB, "Malonyl-[Acyl-Carrier Protein] O-Methyltransferase", Accession No. Q73II1, Jul. 5, 2004, 4 pages.
UNIPROTKB, "Medium-Chain Specific Acyl-CoA Dehydrogenase, Mitochondrial", Accession No. P08503, Aug. 1, 1988, 7 pages.
UNIPROTKB, "NAD-Dependent 4-Hydroxybutyrate Dehydrogenase", Accession No. Q59104, Nov. 1, 1996, 3 pages.
UNIPROTKB, "NAD-Dependent Malic Enzyme", Accession No. P26616, Dec. 6, 2005, 6 pages.
UNIPROTKB, "NAD-Dependent Methanol Dehydrogenase", Accession No. P31005, Jan. 23, 2007, 5 pages.
UNIPROTKB, "NADP-Dependent Alcohol Dehydrogenase 6", Accession No. Q04894, Nov. 1, 1997, 6 pages.

(56) References Cited

OTHER PUBLICATIONS

UNIPROTKB, "NADP-Dependent Malic Enzyme", Accession No. P76558, Feb. 1, 1997, 7 pages.
UNIPROTKB, "Non-Acylating NAD-Dependent Aldehyde Dehydrogenase", Accession No. D9PTN3, Oct. 5, 2010, 3 pages.
UNIPROTKB, "Oleoyl-[Acyl-Carrier-Protein] Hydrolase", Accession No. R6XLC3, Jul. 24, 2013, 2 pages.
UNIPROTKB, "ORF2 Protein", Accession No. Q9ZN75, May 1, 1999, 3 pages.
UNIPROTKB, "ORF3 Protein", Accession No. Q9ZN74, May 1, 1999, 3 pages.
UNIPROTKB, "Oxidoreductase", Accession No. A0A0J8X8T4, Oct. 14, 2015, 5 pages.
UNIPROTKB, "Oxidoreductase", Accession No. A0A0K0X557, Nov. 11, 2015, 5 pages.
UNIPROTKB, "Oxidoreductase", Accession No. A0A0K0XCM7, Nov. 11, 2015, 5 pages.
UNIPROTKB, "Polyhydroxyalkanoate Synthase", Accession No. Q9RNU7, May 1, 2009, 3 pages.
UNIPROTKB, "Probable Aminotransferase Y4UB", Accession No. A0A061M4Q7, Sep. 3, 2014, 3 pages.
UNIPROTKB, "Probable Aminotransferase", Accession No. Q7NWG4, Dec. 15, 2003, 4 pages.
UNIPROTKB, "Probable Class III Aminotransferase", Accession No. Q9HV04, Mar. 1, 2001, 4 pages.
UNIPROTKB, "Propanediol Utilization Protein PduB", Accession No. P37449, Jan. 23, 2002, 4 pages.
UNIPROTKB, "Putative Acyl-ACP Thioesterase Superfamily", Accession No. F5YIQ3, Jul. 27, 2011, 3 pages.
UNIPROTKB, "Putative Acyl-ACP Thioesterase", Accession No. F5YA29, Jul. 27, 2011, 3 pages.
UNIPROTKB, "Putative Acyl-Acyl Carrier Protein Thioesterase", Accession No. E1WY53, Nov. 30, 2010, 3 pages.
UNIPROTKB, "Putative Acyl-CoA Thioesterase YneP", Accession No. Q45061, Sep. 1, 2009, 4 pages.
UNIPROTKB, "Putative Aminotransferase", Accession No. A0A081B6K8, Oct. 29, 2014, 3 pages.
UNIPROTKB, "Putative Aminotransferase", Accession No. G7Z3P2, Jan. 25, 2012, 3 pages.
UNIPROTKB, "Putative Esterase ComA2", Accession No. P14205, Jan. 1, 1990, 4 pages.
UNIPROTKB, "Putative Long-Chain Fatty-Acid-CoA Ligase", Accession No. A0R484, Jan. 9, 2007, 4 pages.
UNIPROTKB, "Putative Pimeloyl-CoA Dehydrogenase (EC 1.3.1.62)", Accession No. Q5P017, Jan. 4, 2005, 4 pages.
UNIPROTKB, "Putative Pimeloyl-CoA Synthetase", Accession No. E9P9F6, Apr. 5, 2011, 2 pages.
UNIPROTKB, "Putrescine Aminotransferase", Accession No. P42588, Jan. 9, 2007, 6 pages.
Lee et al., "Synthesis of Pure Meso-2,3-Butanediol from Crude Glycerol Using an Engineered Metabolic Pathway in *Escherichia coli*", Applied Biochemistry and Biotechnology, vol. 166, No. 7, 2012, pp. 1801-1813.
Li et al., "Cupriavidus Necator JMP134 Rapidly Reduces Furfural with a Zn-Dependent Alcohol Dehydrogenase", Biodegradation, vol. 22, No. 6, 2011, pp. 1215-1225.
Lim et al., "Amplification of the NADPH-Related Genes zwf and gnd for the Oddball Biosynthesis of PHB in an *E. coli* Transformant Harboring a Cloned phbCAB Operon", Journal of Bioscience and Bioengineering, vol. 93, No. 6, 2002, pp. 543-549.
Lin, Steven, "Biotin Synthesis in *Escherichia coli*", University of Illinois at Urbana-Champaign, 2012, 140 pages.
Liu et al., "Production and Characterization of Medium-Chain-Length Polyhydroxyalkanoate with High 3-Hydroxytetradecanoate Monomer Content by fadB and fadA Knockout Mutant of Pseudomonas Putida KT2442", Applied Microbiology and Biotechnology, vol. 76, No. 5, Aug. 1, 2007, pp. 1153-1159.
Lopez-Sanchez et al., "Tetralin-Induced and ThnR-Regulated Aldehyde Dehydrogenase and β-Oxidation Genes in Sphingomonas Macrogolitabida Strain TFA", Applied Environmental Microbialogy, vol. 76, No. 1, Jan. 2010, pp. 110-118.
Martin et al., "Engineering a Mevalonate Pathway in *Escherichia coli* for Production of Terpenoids", Nature Biotechnology, vol. 21, No. 7, Jul. 2003, pp. 796-802.
Martin et al., "High-Titer Production of Monomeric Hydroxyvalerates from Levulinic Acid in Pseudomonas Putida", Journal of Biotechnology, vol. 139, No. 1, 2009, pp. 61-67.
Meijnen et al., "Improved p-Hydroxybenzoate Production by Engineered Pseudomonas Putida S12 by Using a Mixed-substrate Feeding Strategy", Applied Microbiology and Biotechnology, vol. 90, No. 3, 2011, pp. 885-893.
Myers et al., "Optimal Alignments in Linear Space", Bioinformatics, Computer Applications in the Biosciences, vol. 4, No. 1, 1988, pp. 11-17.
Naggert et al., "Cloning, Sequencing, and Characterization of *Escherichia coli* Thioesterase II", The Journal of Biological Chemistry, vol. 266, No. 17, Jun. 15, 1991, pp. 11044-11050.
NCBI, "Carboxylesterase YbfK [*Bacillus subtilis* Subsp. *subtilis* Str. 168]", Reference Sequence: NP_388108.1, May 21, 2017, 2 pages.
Neyfakh, Alexander A., "The Multidrug Efflux Transporter of Bacillus Subtilis is a Structural and Functional Homolog of the *Staphylococcus* NorA Protein", Antimicrobial Agents Chemotherapy, vol. 36, No. 2, Feb. 1992, pp. 484-485.
Ng et al., "Quinolone Resistance Mediated by norA: Physiologic Characterization and Relationship to flqB, a Quinolone Resistance Locus on the *Staphylococcus aureus* Chromosome", Antimicrobial Agents and Chemotherapy, vol. 38, No. 6, Jun. 1994, pp. 1345-1355.
Nishimaki et al., "Studies on the Metabolism of Unsaturated Fatty Acids XIV. Purification and Properties of NADPH-Dependent Trans-2-Enoyl-CoA Reductase of *Escherichia coli* K-12", Journal of Biochemistry, vol. 95, No. 5, 1984, pp. 1315-1321.
Nomura et al., "Expression of 3-Ketoacyl-Acyl Carrier Protein Reductase (fabG) Genes Enhances Production of Polyhydroxyalkanoate Copolymer from Glucose in Recombinant *Escherichia coli* JM109", Applied and Environmental Microbialogy, vol. 71, No. 8, Aug. 2005, pp. 4297-4306.
Ohashi et al., "Continuous Production of Lactic Acid from Molasses by Perfusion Culture of Lactococcus Lactis Using a Stirred Ceramic Membrane Reactor", Journal of Bioscience and Bioengineering, vol. 87, No. 5, 1999, pp. 647-654.
Paik et al., "Enzymic Synthesis of Epsilon-N-Acetyl-L-Lysine", Archives of Biochemistry and Biophysics, vol. 108, Nov. 1, 1964, pp. 221-229.
Papanikolaou et al., "Citric Acid Production by Yarrowia Lipolytica Cultivated on Olive-Mill Wastewater-Based Media", Bioresource Technology, vol. 99, No. 7, 2008, pp. 2419-2428.
Pearson et al., "Improved Tools for Biological Sequence Comparison", Proceedings of the National Academy of Sciences, Biochemistry, vol. 85, Apr. 1988, pp. 2444-2448.
Perez-Pantoja et al., "Metabolic Reconstruction of Aromatic Compounds Degradation from the Genome of the Amazing Pollutant-Degrading Bacterium Cupriavidus Necator JMP134", FEMS Microbiology Reviews, vol. 32, Aug. 7, 2008, pp. 736-794.
Przybylski et al., "Third-Generation Feed Stocks for the Clean and Sustainable Biotechnological Production of Bulk Chemicals: Synthesis of 2-Hydroxyisobutyric Acid", Energy, Sustainability and Society, vol. 2, No. 11, 2012, 9 pages.
Ramsay et al., "Use of a Nylon Manufacturing Waste as an Industrial Fermentation Substrate", Applied and Environmental Microbiology, vol. 52, No. 1, Jul. 1986, pp. 152-156.
Rathnasingh et al., "Development and Evaluation of Efficient Recombinant *Escherichia coli* Strains for the Production of 3-Hydroxypropionic Acid From Glycerol", Biotechnology and Bioengineering, vol. 104, No. 4, Nov. 1, 2009, pp. 729-739.
REFSEQ, "Putrescine:2-Oxoglutaric Acid Aminotransferase, PLP-Dependent [*Escherichia coli* Str. K-12 Substr. MG1655]", Accession No. NP_417544.5, Aug. 8, 2016, 3 pages.
Samsonova et al., "Molecular Cloning and Characterization of *Escherichia coli* K12 ygjG Gene", BMC Microbiology, vol. 3, No. 2, Jan. 31, 2003, pp. 1-10.

(56) References Cited

OTHER PUBLICATIONS

Satoh et al., "Enzyme-Catalyzed Poly(3-Hydroxybutyrate) Synthesis from Acetate with CoA Recycling and NADPH Regeneration in Vitro", Journal of Bioscience and Bioengineering, vol. 95, No. 4, 2003, pp. 335-341.
Seedorf et al., "The Genome of Clostridium Kluyveri, A Strict Anaerobe with Unique Metabolic Features", PNAS USA, vol. 105, No. 6, Feb. 12, 2008, pp. 2128-2133.
Shen et al., "Driving Forces Enable High-Titer Anaerobic 1-Butanol Synthesis in *Escherichia coli*", Applied and Environmental Microbiology, vol. 77, No. 9, May 2011, pp. 2905-2915.
Shikata et al., "A Novel ADP-Forming Succinyl-CoA Synthetase in Thermococcus Kodakaraensis Structurally Related to the Archaeal Nucleoside Diphosphate-forming Acetyl-CoA Synthetases", The Journal of Biological Chemistry, vol. 282, No. 37, Sep. 14, 2007, pp. 26963-26970.
Slater et al., "Multiple β-Ketothiolases Mediate Poly(β-Hydroxyalkanoate) Copolymer Synthesis in Ralstonia Eutropha", Journal of Bacteriology, vol. 180, No. 8, Apr. 1998, pp. 1979-1987.
Stanbury et al., "Principles of Fermentation Technology", 2nd edition, Aeration and Agitation, 1995, 14 pages.
Struck et al., "S-Adenosyl-Methionine-Dependent Methyltransferases: Highly Versatile Enzymes in Biocatalysis, Biosynthesis and Other Biotechnological Applications", Chembiochem, vol. 13, Issue 18, Dec. 21, 2012, pp. 2642-2655.
Suzuki et al., "Acetylputrescine Deacetylase from Micrococcus Luteus K-11", Biochimica et Biophysica Acta (BBA)—General Subjects, vol. 882, Issue 1, Jun. 1986, pp. 140-142.
Suzuki et al., "GriC and GriD Constitute a Carboxylic Acid Reductase Involved in Grixazone Biosynthesis in Streptomyces Griseus", Journal of Antibiotics, vol. 60, No. 6, 2007, pp. 380-387.
UNIPROT, "Acyl-ACP Thioesterase", Accession No. F2JLT2, May 31, 2011, 3 pages.
UNIPROT, "Pimeloyl-[Acyl-Carrier Protein] Methyl Ester Esterase"; Accession No. P13001, Jun. 11, 2014, 8 pages.
UNIPROT, "Uncharacterized Protein", Accession No. A0A084JBW2, Oct. 29, 2014, 2 pages.
UNIPROTKB, "(R)-Specific Enoyl-CoA Hydratase", Accession No. O32472, Jun. 11, 2014, 5 pages.
UNIPROTKB, "3-Hydroxyacyl-[Acyl-Carrier-Protein] Dehydratase FabZ", Accession No. P0A6Q6, Jun. 11, 2014, 6 pages.
UNIPROTKB, "3-Hydroxyacyl-CoA Dehydrogenase", Accession No. Q93SM2, Dec. 1, 2001, 4 pages.
UNIPROTKB, "3-Hydroxybutyryl-CoA Dehydratase", Accession No. A5I6T1, Jun. 26, 2007, 3 pages.
UNIPROTKB, "3-Hydroxybutyryl-CoA Dehydrogenase", Accession No. P52041, Oct. 1, 1996, 4 pages.
UNIPROTKB, "3-Oxoacyl-[Acyl-Carrier Protein] Reductase", Accession No. A0A0X9PXJ6, Apr. 13, 2016, 3 pages.
UNIPROTKB, "3-Oxoacyl-[Acyl-Carrier-Protein] Reductase FabG", Accession No. P0AEK2, May 14, 2014, 8 pages.
UNIPROTKB, "3-Oxoacyl-[Acyl-Carrier-Protein] Synthase 2", Accession No. Q8PNE3, Oct. 1, 2002, 4 pages.
UNIPROTKB, "3-Oxoacyl-[acyl-Carrier-Protein] Synthase 3", Accession No. Q8PNE8, Oct. 1, 2002, 5 pages.
UNIPROTKB, "4-Aminobutyrate Aminotransferase", Accession No. D7CVJ6, Aug. 10, 2010, 3 pages.
UNIPROTKB, "4'-Phosphopantetheinyl Transferase Sfp", Accession No. P39135, Jun. 16, 2009, 5 pages.
UNIPROTKB, "5-Hydroxyvalerate Dehydrogenase", Accession No. Q8GAW4, Mar. 1, 2003, 2 pages.
UNIPROTKB, "Adenosylmethionine-8-Amino-7-Oxononanoate Aminotransferase", Accession No. J2TM48, Oct. 3, 2012, 3 pages.
UNIPROTKB, "Alanine Dehydrogenase", Accession No. P9WQB1, Apr. 16, 2014, 7 pages.
UNIPROTKB, "Alcohol Dehydrogenase YqhD", Accession No. Q46856, Nov. 1, 1996, 5 pages.
UNIPROTKB, "Aldehyde Dehydrogenase (EC 1.2.1.3)", Accession No. A0A0K3BN67, Nov. 11, 2015, 3 pages.
UNIPROTKB, "Aldehyde Dehydrogenase", Accession No. H9L4I6, May 16, 2012, 3 pages.
UNIPROTKB, "Aminotransferase Class-III", Accession No. C7LZG4, Oct. 13, 2009, 4 pages.
UNIPROTKB, "Aminotransferase Class-III", Accession No. D7A1Z2, Aug. 10, 2010, 3 pages.
UNIPROTKB, "Aminotransferase Class-III", Accession No. H0I025, Feb. 22, 2012, 3 pages.
UNIPROTKB, "Aminotransferase Class-III", Accession No. Q4ZLS9, Jun. 7, 2005, 4 pages.
UNIPROTKB, "Aminotransferase", Accession No. A0A011UWB9, Jun. 11, 2014, 3 pages.
UNIPROTKB, "Aminotransferase", Accession No. A0A059IS31, Jul. 9, 2014, 3 pages.
UNIPROTKB, "Aminotransferase", Accession No. A0A086MKC4, Oct. 29, 2014, 3 pages.
UNIPROTKB, "Aminotransferase", Accession No. A0A086YIZ0, Oct. 29, 2014, 3 pages.
UNIPROTKB, "Aminotransferase", Accession No. A0A0C6G014, Apr. 29, 2015, 3 pages.
UNIPROTKB, "Aminotransferase", Accession No. A0A0E9ZHQ3, Jun. 24, 2015, 4 pages.
UNIPROTKB, "Aminotransferase", Accession No. A0A0H1A7R9, Sep. 16, 2015, 3 pages.
UNIPROTKB, "Aminotransferase", Accession No. A0A0H1AH98, Sep. 16, 2015, 3 pages.
UNIPROTKB, "Aminotransferase", Accession No. A0A0H2MDD9, Sep. 16, 2015, 3 pages.
UNIPROTKB, "Aminotransferase", Accession No. I3TH77, Sep. 5, 2012, 3 pages.
UNIPROTKB, "Aminotransferase", Accession No. K2KXB1, Nov. 28, 2012, 3 pages.
UNIPROTKB, "Aminotransferase", Accession No. V7D492, Feb. 19, 2014, 3 pages.
UNIPROTKB, "Aminotransferase, Class III", Accession No. B6ISI5, Dec. 16, 2008, 4 pages.
UNIPROTKB, "Aminotransferase, Class III", Accession No. V4RM39, Jan. 22, 2014, 4 pages.
UNIPROTKB, "AMP-Binding Enzyme Family Protein", Accession No. I7MB41, Oct. 3, 2012, 3 pages.
UNIPROTKB, "Arylesterase", Accession No. A0A0C3EBX5, Apr. 1, 2015, 3 pages.
UNIPROTKB, "Arylesterase", Accession No. A0A0M9UHQ1, Dec. 9, 2015, 3 pages.
UNIPROTKB, "Arylesterase", Accession No. A6D1N2, Jul. 24, 2007, 3 pages.
UNIPROTKB, "Arylesterase", Accession No. Q07792, Feb. 1, 1995, 4 pages.
UNIPROTKB, "Beta-Alanine-Pyruvate Aminotransferase", Accession No. F5Y1J0, Jul. 27, 2011, 3 pages.
UNIPROTKB, "Beta-Ketoacyl-[ACP] Synthase I", Accession No. Q8PGJ1, Oct. 1, 2002, 4 pages.
UNIPROTKB, "Beta-Ketothiolase BktB", Accession No. Q0KBP1, Oct. 3, 2006, 4 pages.
UNIPROTKB, "Carboxylesterase YbfK", Accession No. O31452, Jan. 1, 1998, 4 pages.
UNIPROTKB, "Carboxylic Acid Reductase", Accession No. B2HN69, Jun. 10, 2008, 7 pages.
UNIPROTKB, "Carboxylic Acid Reductase", Accession No. Q6RKB1, Jul. 5, 2004, 6 pages.
UNIPROTKB, "Diguanylate Cyclase (Ggdef) Domain Protein", Accession No. A0QW17, Jan. 9, 2007, 3 pages.
UNIPROTKB, "DNA Gyrase Subunit B", Accession No. F7Z110, Sep. 21, 2011, 5 pages.
UNIPROTKB, "Enoyl-[Acyl-Carrier-Protein] Reductase [NADH] FabI", Accession No. P0AEK4, Jun. 11, 2014, 9 pages.
UNIPROTKB, "Esterase A", Accession No. Q59837, Nov. 1, 1996, 3 pages.
UNIPROTKB, "Esterase TesA", Accession No. A0A0B7DFD2, Apr. 1, 2015, 3 pages.
UNIPROTKB, "Fatty Acid CoA Synthetase Family", Accession No. Q18660, Oct. 1, 2002, 5 pages.

(56) References Cited

OTHER PUBLICATIONS

UNIPROTKB, "Fatty Acyl-CoA Synthetase B", Accession No. Q1ZXQ4, May 2, 2006; 5 pages.
UNIPROTKB, "Fatty-Acid-Coa Ligase FadD", Accession No. H8ITF4, May 16, 2012, 5 pages.
UNIPROTKB, "Fatty-Acid-CoA Ligase FadD9", Accession No. A0A0D6J1A6, May 27, 2015, 4 pages.
UNIPROTKB, "Formaldehyde Dehydrogenase, Glutathione-Independent", Accession No. A3P364, Apr. 3, 2007, 4 pages.
UNIPROTKB, "Formate Dehydrogenase H", Accession No. P07658, Feb. 26, 2008, 6 pages.
UNIPROTKB, "Fructose-1,6-Bisphosphatase Class 1", Accession No. P0A993, Jul. 19, 2005, 7 pages.
UNIPROTKB, "Gamma-Aminobutyrate Transaminase 1, Mitochondrial", Accession No. A0A068SUV9, Oct. 1, 2014, 3 pages.
UNIPROTKB, "Glucose-6-Phosphate 1-Dehydrogenase", Accession No. P0AC53, Nov. 8, 2005, 7 pages.
UNIPROTKB, "Glucose-6-Phosphate Isomerase", Accession No. P06744, Jan. 23, 2007, 12 pages.
Adkins et al., "Engineering Microbial Chemical Factories to Produce Renewable Biomonomers", Frontiers in Microbiology, vol. 3, Article 313, Aug. 2012, pp. 1-12.
Altschul et al., "Gapped Blast and PSI-Blast: A New Generation of Protein Database Search Programs", Nucleic Acids Research (NCIB NLM NIH), Bethesda Md., NAR, vol. 25, No. 17, Jul. 16, 1997, pp. 3389-3402.
Anton et al., "Polyamides, Fibers", Encyclopedia of Polymer Science and Technology, vol. 3, Oct. 22, 2001, pp. 584-612.
Ausubel et al., "Current Protocols in Molecular Biology", Greene Publishing Associates/Wiley Interscience, New York, Supplement 30, section 7.7.18, 1987, 1 page.
Barker et al., "Enzymatic Reactions in the Degradation of 5-Aminovalerate by Clostridium Aminovalericum", The Journal of Biological Chemistry, vol. 262, No. 19, Jul. 5, 1987, pp. 8994-9003.
Becker et al., "Metabolic Flux Engineering of I-Lysine Production in Corynebacterium Glutamicum—Over Expression and Modification of G6P Dehydrogenase", Journal of Biotechnology, vol. 132, Oct. 31, 2007, pp. 99-109.
Bellmann et al., "Expression Control and Specificity of the Basic Amino Acid Exporter LysE of Corynebacterium Glutamicum", Microbiology, vol. 147, Jul. 1, 2001, pp. 1765-1774.
Blombach et al., "Current Knowledge on Isobutanol Production with *Escherichia coli*, Bacillus Subtilis and Corynebacterium Glutamicum", Bioengineered Bugs, vol. 2, No. 6, 2011, pp. 346-350.
Bond-Watts et al., "Biochemical and Structural Characterization of the Trans-Enoyl-CoA Reductase from Treponema Denticola", Biochemistry, vol. 51, No. 34, 2012, pp. 6827-6837.
Brigham et al., "Engineering Ralstonia Eutropha for Production of Isobutanol from CO2, H2, and O2", Advanced Biofuels and Bioproducts, Chapter 39, Jan. 2013, pp. 1065-1090.
Buckel et al., "Glutaconate CoA-Transferase from Acidaminococcus Fermentans", European Journal of Biochemistry, vol. 118, 1981, pp. 315-321.
Budde et al., "Roles of Multiple Acetoacetyl Coenzyme A Reductases in Polyhydroxybutyrate Biosynthesis in Ralstonia Eutropha H16", Journal of Bacteriology, vol. 192 No. 20, Oct. 2010, pp. 5319-5328.
Bugg et al., "The Emerging Role for Bacteria in Lignin Degradation and Bio-Product Formation", Current Opinion in Biotechnology, vol. 22, 2011, pp. 394-400.
Cantu et al., "Thioesterases: A New Perspective Based on Their Primary and Tertiary Structures", Protein Science, vol. 19, May 17, 2010, pp. 1281-1295.
Chan et al., "Production of Succinic Acid from Sucrose arid Sugarcane Molasses by Metabolically Engineered *Escherichia coli*", Bioresource Technology, vol. 103, 2012, pp. 329-336.

Chotani et al., "The Commercial Production of Chemicals Using Pathway Engineering", Biochimica et Biophysica Acta (BBA)—Protein Structure and Molecular Enzymology, vol. 1543, Issue 2, Dec. 29, 2000, pp. 434-455.
Craig et al., "Kinetics of Ester Hydrolysis by Horse Liver Esterase. II", Journal of The American Chemical Society, vol. 80, No. 7, Apr. 1958, pp. 1574-1579.
Demain et al., "Manual of Industrial Microbiology and Biotechnology", 2nd Edition, Scale-Up of Microbial Processes, ASM Press, 1999, 5 pages.
Elkins et al., "Substrate Specificity of the RND-Type Multidrug Efflux Pumps AcrB and AcrD of *Escherichia coli* Is Determined Predominately by Two Large Periplasmic Loops", Journal of Bactiriology, vol. 184, No. 23, Dec. 2002, pp. 6490-6498.
Fukui et al., "Expression and Characterization of (R)-Specific Enoyl Coenzyme A Hydratase Involved in Polyhydroxyalkanoate Biosynthesis by Aeromonas Caviae", Journal of Bacterialogy, vol. 180, No. 3, Feb. 1998, pp. 667-673.
GENBANK, "Adenosylmethionine-8-Amino-7-Oxononanoate Aminotransferase [Rhodobacter Sphaeroides 2.4.1]", Accession No. ABA81135.1, Jul. 20, 2015, 2 pages.
GENBANK, "Aminotransferase Class-III [Pseudomonas Syringae Pv. Syringae B728a]", Accession No. AAY39893.1, Jan. 31, 2014, 2 pages.
GENBANK, "Fatty-Acid-CoA Ligase FadD9 [*Mycobacterium marinum* M]", Accession No. ACC40567.1, Jan. 31, 2014, 2 pages.
GENBANK, "Hypothetical Protein HMPREF1093_02514 [[Clostridium] Hathewayi 12489931]", Accession No. ENY95204.1, Apr. 19, 2013, 2 pages.
GENBANK, "NAD Dependent Epimerase/Dehydratase Family Protein [*Mycobacterium Smegmatis* Str. MC2 155]", Accession No. ABK75684.1, Jan. 31, 2014, 2 pages.
GENBANK, "Phosphopantetheinyl Transferase [Nocardia Lowensis]", Accession No. ABI83656.1, Jan. 3, 2007, 1 page.
GENBANK, "Probable Aminotransferase [Chromobacterium Violaceum ATCC 12472]", Accession No. AAQ59697.1, Jan. 31, 2014, 2 pages.
GENBANK, "Probable Class III Aminotransferase [Pseudomonas Aeruginosa PAO1]", Accession No. AAG08191.1, Jan. 31, 2014, 2 pages.
GENBANK, "Putative Fatty-Acid-CoA Ligase FADD9 [*Mycobacterium abscessus* Subsp. *bolletii* 2B-0307]", Accession No. EIV11143.1, Dec. 19, 2014, 2 pages.
GENBANK, "Putative Long-Chain Fatty-Acid-CoA Ligase [*Mycobacterium smegmatis* Str. MC2 155]", Accession No. ABK71854.1, Jan. 31, 2014, 2 pages.
GENBANK, "Pyruvate Transaminase [Vibrio Fluvialis]", Accession No. AEA39183.1, Apr. 4, 2011, 1 page.
GENBANK, "Thioester Reductase Domain Protein [Segniliparus Rotundus DSM 44985]", Accession No. ADG98140.1, Jan. 28, 2014, 2 pages.
GENBANK, "Thioester Reductase Domain-Containing Protein [Segniliparus Rugosus ATCC BAA-974]", Accession No. EFV11917.1, Sep. 9, 2013, 3 pages.
Gloerich et al., "Peroxisomal Trans-2-Enoyl-CoA Reductase is Involved in Phytol Degradation", FEBS Letters, vol. 580, Mar. 10, 2006, pp. 2092-2096.
Guerrillot et al., "Purification and Characterization of Two Aldehyde Dehydrogenases from Pseudomonas Aeruginosa", European Journal of Biochemestry, vol. 81, Nov. 1977, pp. 185-192.
Harwood et al., "The Beta-Ketoadipate Pathway and the Biology of Self-Identity", Annual Review of Microbiology, vol. 50, Oct. 1996, pp. 553-590.
Haywood et al., "Characterization of Two 3-Ketothiolases Possessing Differing Substrate Specificities in the Polyhydroxyalkanoate Synthesizing Organism Alcaligenes Eutrophus", FEMS Microbiology Letters, vol. 52, Jul. 1988, pp. 91-96.
Hermann, Thomas, "Industrial Production of Amino Acids by Coryneform Bacteria", Journal of Biotechnology, vol. 104, 2003, pp. 155-172.

(56) References Cited

OTHER PUBLICATIONS

Huhn et al., "Identification of the Membrane Protein SucE and its Role in Succinate Transport in Corynebacterium Glutamicum", Applied Microbiology and Biotechnology, vol. 89, Jan. 2011, pp. 327-335.

Iwaki et al., "Cloning and Characterization of a Gene Cluster Involved in Cyclopentanol Metabolism in Comamonas Sp. Strain NCIMB 9872 and Biotransformations Effected by Escherichia coli-Expressed Cyclopentanone 1,2-Monooxygenase", Applied and Environmental Microbiology, vol. 68, No. 11, Nov. 2002, pp. 5671-5684.

Iwaki et al., "Identification of a Transcriptional Activator (ChnR) and a 6-Oxohexanoate Dehydrogenase (ChnE) in the Cyclohexanol Catabolic Pathway in Acinetobacter Sp. Strain NCIMB 9871 and Localization of the Genes That Encode Them", Applied and Environmental Microbiology, vol. 65, No. 11, Nov. 1999, pp. 5158-5162.

Jaremko et al., "The Initial Metabolic Conversion of Levulinic Acid in Cupriavidus Necator", Journal of Biotechnology, vol. 155, 2011, pp. 293-298.

Kaulmann et al., "Substrate Spectrum of ω-Transaminase from Chromobacterium Violaceum DSM30191 and its Potential for Biocatalysis", Enzyme and Microbial Technology, vol. 41, Oct. 2007, pp. 628-637.

Kim, Ki-Han, "Purification and Properties of a Mine α-Ketoglutarate Transaminase from Escherichia coli", The Journal of Biological Chemistry, vol. 239, No. 3, Mar. 1, 1964, pp. 783-786.

Kopke et al., "2,3-Butanediol Production by Acetogenic Bacteria, an Alternative Route to Chemical Synthesis, Using Industrial Waste Gas", Applied and Environmental Microbiology, vol. 77, No. 15, Aug. 2011, pp. 5467-5475.

Kunst et al., "The Complete Genome Sequence of the Gram-Positive Bacterium Bacillus Subtilis", Nature, vol. 390, No. 6657, Nov. 20, 1997, pp. 249-256.

Lan et al., "Oxygen-Tolerant Coenzyme A-Acylating Aldehyde Dehydrogenase Facilitates Efficient Photosynthetic N-Butanol Biosynthesis in Cyanobacteria", Energy & Environmental Science, vol. 6, 2013, pp. 2672-2681.

Larroy et al., "Characterization of the Saccharomyces cerevisiae YMR318C (ADH6) Gene Product as a Broad Specificity NADPH-Dependent Alcohol Dehydrogenase: Relevance in Aldehyde Reduction", Biochem Journal, vol. 361, No. 1, Jan. 1, 2002, pp. 163-172.

Lee et al., "Heterologous Co-Expression of AccA, FabD, and Thioesterase Genes for Improving Long-Chain Fatty Acid Production in Pseudomonas Aeruginosa and Escherichia coli", Applied Biochemistry and Biotechnology, vol. 167, No. 1, 2012, pp. 24-38.

Lee et al., "Metabolic Engineering of Pentose Phosphate Pathway in Ralstonia Eutropha for Enhanced Biosynthesis of Poly-β-Hydroxybutyrate", Biotechnology Progress, vol. 19, Issue 5, 2003, pp. 1444-1449.

Lin et al., "Biotin synthesis begins by hijacking the fatty acid synthetic pathway", Nature Chemical Biology, vol. 6, No. 9, pp. 682-688, 2010. (Abstract) (1 page).

Lin et al., "The BioC O-methyltransferase catalyzes methyl esterification of malonyl-acyl carrier protein, an essential step in biotin synthesis", Journal of Biological Chemistry, vol. 287, No. 44, pp. 37010-37020, 2012. (Abstract) (1 page).

Zaccai et al., "Crystal structure of a 3-oxoacyl-(acyl carrier protein) reductase (BA3989) from Bacillus anthracis at 2.4-A resolution", Proteins, vol. 70, No. 2, 562-567, 2007.

Gill et al., "Insights on evolution of virulence and resistance from the complete genome analysis of an early methicillin-resistant Staphylococcus aureus strain and a biofilm-producing methicillin-resistant Staphylococcus epidermidis strain", Journal of Bacteriology, vol. 187, No. 7, pp. 2426-2438, 2005. (Abstract) (1 page).

Haushalter et al., "Production of Odd-Carbon Dicarboxylic Acids in Escherichia coli Using an Engineered Biotin-Fatty Acid Biosynthetic Pathway", Journal of the American Chemical Society, vol. 139, No. 13, pp. 4615-4618, 2017. (Abstract) (1 page).

Shapiro et al., "Remarkable Diversity in the Enzymes Catalyzing the Last Step in Synthesis of the Pimelate Moiety of Biotin", Plos One, vol. 7, No. 11, p. e49440, 2012. (Abstract) (1 page).

* cited by examiner

*n* is the number of methyl ester shielded carbon chain elongation cycles $n$ is the number of methyl ester shielded carbon chain elongation cycles FIG. 21
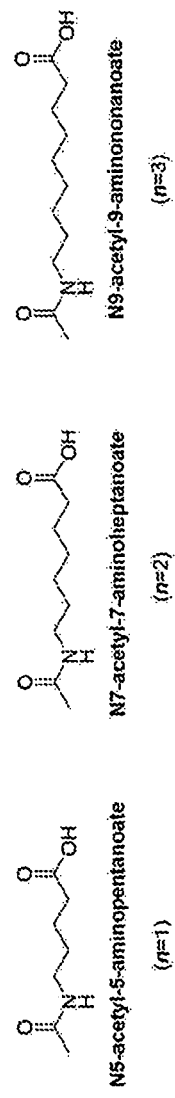
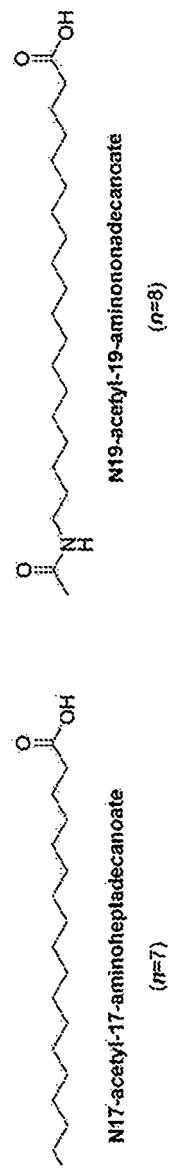
*n* is the number of methyl ester shielded carbon chain elongation cycles
$H_3CC(=O)NH(CH_2)_{2n+2}CO_2H$ (acetamidocarboxylate)

FIG. 27

*m* is the cycle of methyl ester shielded carbon chain elongation in progress

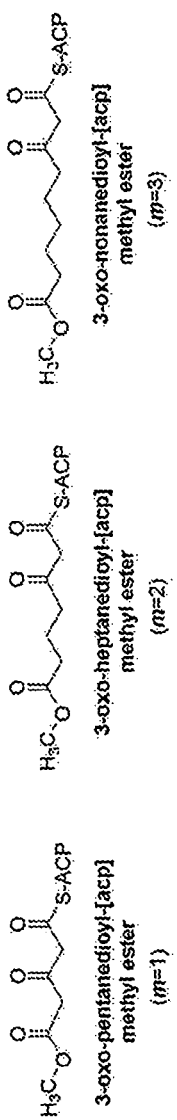

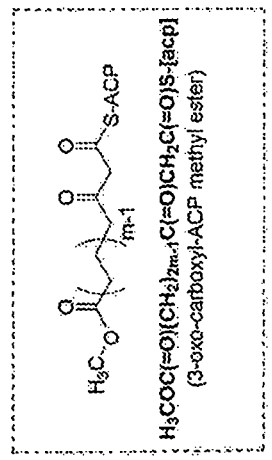

H₃COC(=O)[CH₂]₂ₘ₋₁C(=O)[CH₂C(=O)]S-[acp]
(3-oxo-carboxyl-ACP methyl ester)

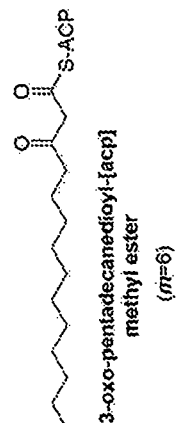
3-oxo-pentanedioyl-[acp] methyl ester
(*m*=1)

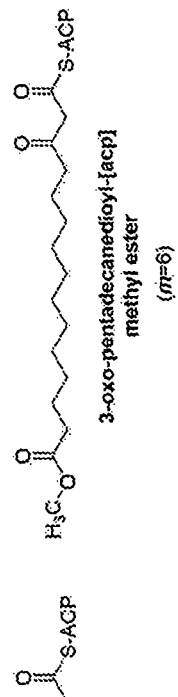
3-oxo-heptanedioyl-[acp] methyl ester
(*m*=2)

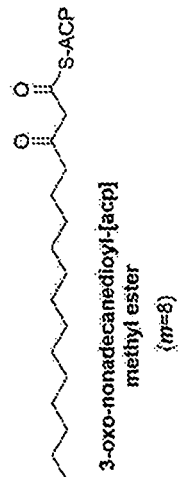
3-oxo-nonanedioyl-[acp] methyl ester
(*m*=3)

3-oxo-undecanoyl-[acp] methyl ester
(*m*=4)

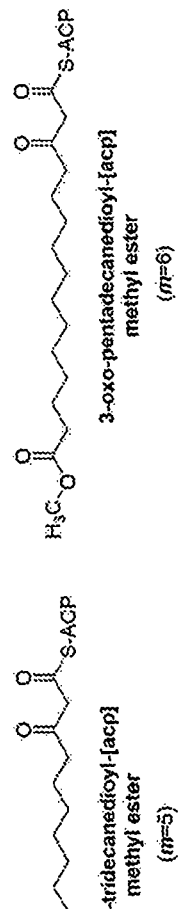
3-oxo-tridecanedioyl-[acp] methyl ester
(*m*=5)

3-oxo-pentadecanedioyl-[acp] methyl ester
(*m*=6)

3-oxo-heptadecanedioyl-[acp] methyl ester
(*m*=7)

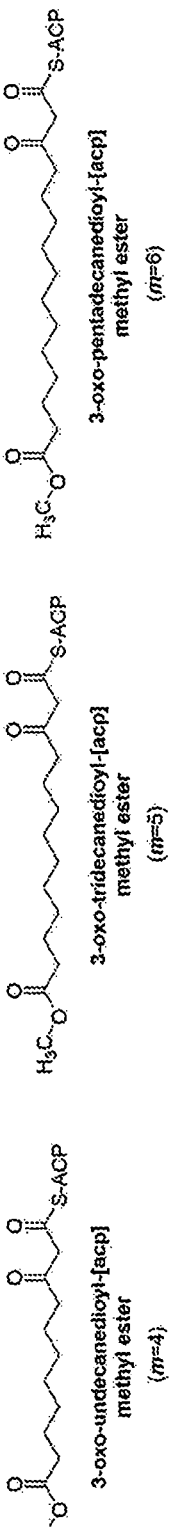
3-oxo-nonadecanedioyl-[acp] methyl ester
(*m*=8)

FIG. 54

| Strain | Genotype | Methionine (KanR) | BIOCBDH (CmR) | Acc (GenR) |
|---|---|---|---|---|
| INV0507 | ΔfadE::FRT | pINV0267 (MetK(Mtn)) | pINV0257 (proC::BioC8(BioH3)) | pINV0252 (Acc) |
| INV0480 | ΔfadE::FRT | pINV0269 (empty) | | |
| INV0508 | ΔfadE::FRT ΔmetJ::FRT | pINV0267 (MetK(Mtn)) | | |
| INV0509 | ΔfadE::FRT ΔmetJ::FRT | pINV0269 (empty) | | |

FIG. 55

| Assay conditions | | Comments |
|---|---|---|
| Strains | INV0507, 0508, 0509, 0409 | 4 strains with Acc |
| Triplicate | n = 3 | 12 flasks |
| AA supplementation | None | |
| Media | INV1 + kan + camp + spec | Standard Invista defined media |
| Volume of culture | 100 mL | Final volume post-sampling 52 mL |
| Flask size | 500 mL | |
| Overnight culture | Start at OD600 0.1 | |
| Backdilution | To OD600 1 | |
| Growth | 250 rpm, 30 °C | |
| Sampling | 12 mL pr time point Extracellular pimelate and intracellular (later) SAM analysis | Falcons must all be pre-weighed to compare WCW with OD |
| Timing | 15.5 h, 23 h, 38 h, 43.5 h | |

FIG. 56

| Assay conditions | | Comments |
|---|---|---|
| Strains | NV0508 | ΔfadE::FRT ΔmetJ::FRT MetK/Mtn BioC8/BioH3 Acc |
| Additives | Methionine 5 g/L (~30 mM) Serine 5 g/L (~47 mM) | No suppl control included in previous experiment |
| Triplicate | n = 3 | 6 flasks |
| Media | INV1 + kan + camp + spec | Standard Invista defined media |
| Volume of culture | 100 mL | Final volume post sampling 52 mL |
| Flask size | 500 mL | |
| Overnight culture | Start at OD 0.1 | |
| Backdilution | To OD 1, add additives | |
| Growth | 250 rpm, 30 °C | |
| Sampling | 12 mL pr time point Extracellular pimelate and intracellular (later) SAM analysis | Falcons must all be pre-weighed to compare WCW with OD |
| Timing | 15.5 h, 23 h, 38 h, 43.5 h | |

FIG. 58

| Parameter | Lincomic | Lincomycin |
|---|---|---|
| Column Type | Whatman PartiSphere C18 250 x 4.6 mm (5 μm) | Gracesmart C18 150 x 4.6 mm (5 μm) |
| Mobile Phase | Line A: 50 mM NaH2PO4 + 8 mM octanesulfonic acid<br>Line B: Methanol | Line A: 50 mM NaH2PO4 + 8mM octanesulfonic acid<br>Line B: Methanol |
| Gradient | Time %B<br>0 20<br>8 20<br>8.5 40<br>21 40<br>21.5 20<br>30 20 | Time %B<br>0 20<br>3 20<br>3.5 60<br>7 60<br>7.5 20<br>15 20 |
| Run time | 30 min | 15 min |
| Detection | UV 254 nm | UV 210/254 nm |
| Inj volume | 25 μL | 25 μL |
| Flow rate | 1 mL min$^{-1}$ | 1 mL min$^{-1}$ |

METHODS AND MATERIALS FOR BIOSYNTHESIZING MULTIFUNCTIONAL, MULTIVARIATE MOLECULES VIA CARBON CHAIN MODIFICATION

CROSS-REFERENCE TO RELATED APPLICATIONS

The present application claims the benefit of U.S. Provisional Application No. 62/366,539, filed on Jul. 25, 2016, and U.S. Provisional Application No. 62/527,415, filed Jun. 30, 2017, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jul. 25, 2017, is named 12444_0683-00000_SL.txt and is 817,030 bytes in size.

TECHNICAL FIELD

This disclosure relates to materials and methods for biosynthesizing one or more compounds having an odd number of carbon atoms, for example, five to nineteen carbon atoms. This disclosure also relates to materials and methods for biosynthesizing one or more difunctional products having an aliphatic carbon chain backbone having an odd number of carbon atoms between five and nineteen inclusive and having two terminal functional groups selected from carboxyl, formyl, amine, and hydroxyl or salts or derivatives thereof (hereafter "$C_5$-$C_{19}$ building blocks") from propanedioyl-CoA or propanedioyl-[acp] and optionally acetyl-CoA using one or more polypeptides having the activity of one or more enzymes such as methyltransferases, β-ketoacyl-[acp] synthases, β-ketothiolases, dehydrogenases, reductases, hydratases, thioesterases, esterases, CoA-transferases, reversible CoA-ligases, and aminotransferases or using recombinant host cells expressing one or more nucleic acids encoding such enzymes in genetically modified hosts. The disclosure provides biochemical pathways in which a methyl ester shield is added to propanedioyl-CoA or propanedioyl-[acp] before undergoing one or more cycles of carbon chain elongation, wherein the methyl ester shield is maintained for at least one further enzymatic step following the one or more cycles of carbon chain elongation.

BACKGROUND

Nylons are synthetic polyamides which are sometimes synthesized by the condensation polymerisation of a diamine with a dicarboxylic acid. Similarly, Nylons may be produced by the condensation polymerisation of lactams. For example, a ubiquitous Nylon is Nylon 6,6, which is produced by reaction of hexamethylenediamine (HMD) and adipic acid. Nylon 6 is produced by a ring opening polymerisation of caprolactam (Anton & Baird, Polyamides Fibers, Encyclopedia of Polymer Science and Technology, 2001).

Given the lack of economically cost competitive petrochemical monomer feedstocks, biotechnology offers an alternative approach via biocatalysis. Biocatalysis is the use of biological catalysts, such as enzymes, to perform biochemical transformations of organic compounds. Both bio-derived feedstocks and petrochemical feedstocks are viable starting materials for the biocatalysis processes.

However, no wild-type prokaryote or eukaryote naturally overproduces or excretes difunctional products having an odd number of carbon chain atoms, such as, for example, $C_5$-$C_{19}$ building blocks, to the extracellular environment. Nevertheless, the metabolism of the $C_7$ dicarboxylic acid (heptanedioic acid) has been reported.

The $C_7$ dicarboxylic acid, heptanedioic acid, is converted efficiently as a carbon source by a number of bacteria and yeasts via β-oxidation into central metabolites. β-oxidation of CoEnzyme A (CoA) activated heptanedioate to CoA-activated 3-oxoheptanedioate facilitates further catabolism via, for example, pathways associated with aromatic substrate degradation. The catabolism of 3-oxopimeloyl-CoA to acetyl-CoA and glutaryl-CoA by several bacteria has been characterized comprehensively (Harwood and Parales, Annual Review of Microbiology, 1996, 50, 553-590).

The optimality principle states that microorganisms regulate their biochemical networks to support maximum biomass growth. Beyond the need to express heterologous pathways in a host organism, directing carbon flux towards $C_5$-$C_{19}$ building blocks (i.e., $C_5$, $C_7$, $C_9$, $C_{11}$, $C_{13}$, $C_{15}$, $C_{17}$, or $C_{19}$ building blocks) that serve as carbon sources rather than to biomass growth constituents, contradicts the optimality principle. For example, transferring the 1-butanol pathway from *Clostridium* species into other production strains has often fallen short by an order of magnitude compared to the production performance of native producers (Shen et al., *Appl. Environ. Microbiol.*, 2011, 77(9), 2905-2915).

The synthesis of an aliphatic carbon backbone precursor having an odd number of carbon atoms, for example, between five and nineteen carbons, is a key consideration in synthesizing difunctional products having an odd number of carbon atoms (i.e., $C_5$-$C_{19}$ building blocks) prior to forming terminal functional groups, such as carboxyl, formyl, amine, or hydroxyl groups, on the $C_5$-$C_{19}$ aliphatic backbone.

SUMMARY

Accordingly, against this background, it is clear that there is a need for methods for producing products having two terminal functional groups and an odd number of carbon chain atoms, or salts or derivatives thereof, wherein the methods are biocatalyst-based. For example, there is a need for methods for producing difunctional products having an odd number of carbon atoms between five and nineteen (i.e., 5, 7, 9, 11, 13, 15, 17, or 19 carbon atoms) and two terminal functional groups (hereafter $C_5$-$C_{19}$ building blocks). Described herein are methods and genetically modified hosts that allow for more efficient use of five to nineteen carbon aliphatic backbone precursors and the production of $C_5$-$C_{19}$ building blocks, for example, by use of a recombinant host in a bioH deficient background.

This document is based at least in part on the discovery that it is possible to construct biochemical pathways for producing a five to nineteen carbon chain aliphatic backbone precursor (i.e., an aliphatic backbone with 5, 7, 9, 11, 13, 15, 17, or 19 carbon atoms), in which one or two functional groups, i.e., carboxyl, formyl, amine, or hydroxyl, can be formed, leading to the synthesis of one or more products having two terminal functional groups, or salts or derivatives thereof ($C_5$-$C_{19}$ building blocks). These may be, for example, dicarboxylic acids, carboxylate semialdehydes, aminocarboxylates, hydroxycarboxylates, diamines, or diols. The compound may exist in any of its neutral or ionized forms, including any salt forms thereof. It is understood by those skilled in the art that the specific form will depend on pH.

For compounds containing carboxylic acid groups such as organic monoacids, hydroxyacids, aminoacids, and dicarboxylic acids, these compounds may be formed or converted to their ionic salt form when an acidic proton present in the parent compound either is replaced by a metal ion, e.g., an alkali metal ion, an alkaline earth ion, or an aluminum ion; or coordinates with an organic base. Acceptable organic bases include ethanolamine, diethanolamine, triethanolamine, tromethamine, N-methylglucamine, and the like. Acceptable inorganic bases include aluminum hydroxide, calcium hydroxide, potassium hydroxide, sodium carbonate, sodium hydroxide, and the like. The salt can be isolated as is from the system as the salt or converted to the free acid by reducing the pH to below the pKa through addition of acid or treatment with an acidic ion exchange resin.

For compounds containing amine groups such as but not limited to organic amines, aminoacids and diamines, these compounds may be formed or converted to their ionic salt form by addition of an acidic proton to the amine to form the ammonium salt, formed with inorganic acids such as hydrochloric acid, hydrobromic acid, sulfuric acid, nitric acid, phosphoric acid, and the like; or formed with organic acids such as acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl)benzoic acid, cinnamic acid, mandelic acid, methanesulfonic acid, ethanesulfonic acid, 1,2-ethanedisulfonic acid, 2-hydroxyethanesulfonic acid, benzenesulfonic acid, 2-naphthalenesulfonic acid, 4-methylbicyclo-[2.2.2]oct-2-ene-1-carboxylic acid, glucoheptonic acid, 4,4'-methylenebis-(3-hydroxy-2-ene-1-carboxylic acid), 3-phenylpropionic acid, trimethylacetic acid, tertiary butylacetic acid, lauryl sulfuric acid, gluconic acid, glutamic acid, hydroxynaphthoic acid, salicylic acid, stearic acid or muconic acid. Acceptable inorganic bases are known in the art and include aluminum hydroxide, calcium hydroxide, potassium hydroxide, sodium carbonate, sodium hydroxide, and the like. The salt can be isolated as is from the system as a salt or converted to the free amine by raising the pH to above the pKb through addition of base or treatment with a basic ion exchange resin.

For compounds containing both amine groups and carboxylic acid groups such as but not limited to aminocarboxylates, these compounds may be formed or converted to their ionic salt form by either 1) acid addition salts, formed with inorganic acids such as hydrochloric acid, hydrobromic acid, sulfuric acid, nitric acid, phosphoric acid, and the like; or formed with organic acids such as acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl)benzoic acid, cinnamic acid, mandelic acid, methanesulfonic acid, ethanesulfonic acid, 1,2-ethanedisulfonic acid, 2-hydroxyethanesulfonic acid, benzenesulfonic acid, 2-naphthalenesulfonic acid, 4-methylbicyclo-[2.2.2]oct-2-ene-1-carboxylic acid, glucoheptonic acid, 4,4'-methylenebis-(3-hydroxy-2-ene-1-carboxylic acid), 3-phenylpropionic acid, trimethylacetic acid, tertiary butylacetic acid, lauryl sulfuric acid, gluconic acid, glutamic acid, hydroxynaphthoic acid, salicylic acid, stearic acid, muconic acid Acceptable inorganic bases include aluminum hydroxide, calcium hydroxide, potassium hydroxide, sodium carbonate, sodium hydroxide, and the like, or 2) when an acidic proton present in the parent compound either is replaced by a metal ion, e.g., an alkali metal ion, an alkaline earth ion, or an aluminum ion; or coordinates with an organic base. Acceptable organic bases are known in the art and include ethanolamine, diethanolamine, triethanolamine, tromethamine, N-methylglucamine, and the like. Acceptable inorganic bases are known in the art and include aluminum hydroxide, calcium hydroxide, potassium hydroxide, sodium carbonate, sodium hydroxide, and the like. The salt can be isolated as is from the system or converted to the free acid by reducing the pH to below the pKa through addition of acid or treatment with an acidic ion exchange resin.

The pathways, metabolic engineering strategies, and cultivation strategies described herein rely on fatty acid elongation and synthesis enzymes or homologs accepting methyl-ester shielded dicarboxylic acids as substrates.

In the face of the optimality principle, it surprisingly has been discovered that appropriate non-natural pathways, feedstocks, host microorganisms, attenuation strategies to the host's biochemical network and cultivation strategies may be combined to efficiently produce one or more difunctional products having an odd number of carbon atoms, such as, for example, $C_5$-$C_{19}$ building blocks.

Each of said one or more cycles of carbon chain elongation to produce the aliphatic carbon chain backbone having an odd number of carbon atoms, such as, for example, an aliphatic carbon chain backbone five to nineteen carbons in length, comprises using (i) a β-ketoacyl-[acp] synthase or a β-ketothiolase, (ii) a 3-oxoacyl-[acp] reductase, an acetoacetyl-CoA reductase, a 3-hydroxyacyl-CoA dehydrogenase or a 3-hydroxybutyryl-CoA dehydrogenase, (iii) an enoyl-CoA hydratase or a 3-hydroxyacyl-[acp] dehydratase, and (iv) an enoyl-[acp] reductase or a trans-2-enoyl-CoA reductase to produce said aliphatic carbon chain backbone from propanedioyl-[acp]methyl ester or from propanedioyl-CoA methyl ester. A S-adenosyl-L-methionine (SAM)-dependent methyltransferase may convert propanedioyl-CoA to propanedioyl-CoA methyl ester or convert propanedioyl-[acp] to propanedioyl-[acp] methyl ester before said one or more cycles of methyl-ester shielded carbon chain elongation.

In some embodiments, a $C_{2n+3}$ aliphatic backbone containing (2n+3) carbon atoms, wherein n is an integer greater than or equal to one, is enzymatically synthesized from (i) acetyl-CoA and propanedioyl-CoA via n cycles of methyl ester shielded carbon chain elongation or (ii) propanedioyl-[acp] via n cycles of methyl ester shielded carbon chain elongation. In some embodiments, a $C_{2n+3}$ aliphatic backbone may be formed from propanedioyl-[acp] or propanedioyl-CoA, and optionally acetyl-CoA, via one or more cycles of carbon chain elongation using polypeptides having the activity of one or more either NADH or NADPH dependent enzymes.

For example, $C_5$, $C_7$, $C_9$, $C_{11}$, $C_{13}$, $C_{15}$, $C_{17}$, or $C_{19}$ aliphatic backbones may be enzymatically synthesized from (i) acetyl-CoA and propanedioyl-CoA via 1, 2, 3, 4, 5, 6, 7, or 8 cycles of methyl ester shielded carbon chain elongation, respectively, or (ii) propanedioyl-[acp] via 1, 2, 3, 4, 5, 6, 7, or 8 cycles of methyl ester shielded carbon chain elongation, respectively. $C_5$, $C_7$, $C_9$, $C_{11}$, $C_{13}$, $C_{15}$, $C_{17}$, or $C_{19}$ aliphatic backbones disclosed herein include: i) $C_5$: pentanedioyl-[acp] methyl ester or pentanedioyl-CoA methyl ester, ii) $C_7$: heptanedioyl-[acp]methyl ester or heptanedioyl-CoA methyl ester, iii) $C_9$: nonanedioyl-[acp] methyl ester or nonanedioyl-CoA methyl ester, iv) $C_{11}$: undecanedioyl-[acp] methyl ester or undecanedioyl-CoA methyl ester, v) $C_{13}$:

tridecanedioyl-[acp] methyl ester or tridecanedioyl-CoA methyl ester, vi) $C_{15}$: pentadecanedioyl-[acp] methyl ester or pentadecanedioyl-CoA methyl ester, vii) $C_{17}$: heptadecanedioyl-[acp] methyl ester or heptadecanedioyl-CoA methyl ester, or viii) $C_{19}$: nonadecanedioyl-[acp] methyl ester or nonadecanedioyl-CoA methyl ester. See FIGS. 9 and 10.

In some embodiments, a $C_{2n+3}$ aliphatic backbone is converted to one or more $C_{2n+3}$ building blocks. As used herein, a "$C_{2n+3}$ building block" is a difunctional compound having (2n+3) carbon atoms, wherein n is an integer greater than or equal to one, and two terminal functional groups selected from carboxyl, formyl, amine, and hydroxyl groups. Difunctional compounds having an odd number of carbon atoms described herein include dicarboxylic acids, carboxylate semialdehydes, aminocarboxylates, hydroxycarboxylates, diamines, and diols.

In some embodiments, a terminal carboxyl group can be enzymatically formed using one or more polypeptides having the activity of one or more esterase, thioesterase, aldehyde dehydrogenase, 7-oxoheptanoate dehydrogenase, 6-oxohexanoate dehydrogenase, reversible CoA ligase (e.g., reversible succinyl-CoA ligase), or CoA-transferase (e.g., glutaconate CoA-transferase).

In some embodiments, a terminal amine group can be enzymatically formed using a polypeptide having the activity of an aminotransferase or a deacetylase.

In some embodiments, a terminal hydroxyl group can be enzymatically formed using a polypeptide having the activity of a 4-hydroxybutyrate dehydrogenase, a 5-hydroxypentanoate dehydrogenase, a 6-hydroxyhexanoate dehydrogenase, or an alcohol dehydrogenase.

In one aspect, this document features a method for biosynthesizing a difunctional product having an aliphatic carbon backbone with an odd number of carbon atoms (e.g., between five and nineteen carbon atoms) and two terminal functional groups selected from carboxyl, formyl, amine, and hydroxyl groups, or salts or derivatives thereof.

The difunctional product having an odd number of carbon atoms may be selected from dicarboxylic acids, carboxylate semialdehydes, aminocarboxylates, hydroxycarboxylates, diamines, and diols. For example, the difunctional product may be selected from pentanedioic acid, 5-oxopentanoate, 5-aminopentanoate, 5-hydroxypentanoate, pentane-1,5-diamine, and 1,5-pentanediol; heptanedioic acid, 7-oxoheptanoate, 7-aminoheptanoate, 7-hydroxyheptanoate, heptane-1,7-diamine, and 1,7-heptanediol; nonanedioic acid, 9-oxononanoate, 9-aminononanoate, 9-hydroxynonanoate, nonane-1,9-diamine, and 1,9-nonanediol; undecanedioic acid, 11-oxoundecanoate, 11-aminoundecanoate, 11-hydroxyundecanoate, undecane-1,11-diamine, and 1,11-undecanediol; tridecanedioic acid, β-oxotridecanoate, 13-aminotridecanoate, 13-hydroxytridecanoate, tridecane-1,13-diamine, and 1,13-tridecanediol; pentadecanedioic acid, 15-oxopentadecanoate, 15-aminopentadecanoate, 15-hydroxypentadecanoate, pentadecane-1,15-diamine, and 1,15-pentadecanediol; heptadecanedioic acid, 17-oxoheptadecanoate, 17-aminoheptadecanoate, 17-hydroxyheptadecanoate, heptadecane-1,17-diamine, and 1,17-heptadecanediol; nonadecanedioic acid, 19-oxononadecanoate, 19-aminononadecanoate, 19-hydroxynonadecanoate, nonadecane-1,19-diamine, and 1,19-nonadecanediol.

In some embodiments, the method includes (a) enzymatically synthesizing an aliphatic carbon chain backbone having an odd number of carbon atoms from (i) acetyl-CoA and propanedioyl-CoA via one or more cycles of methyl ester shielded carbon chain elongation or (ii) propanedioyl-[acp] via one or more cycles of methyl ester shielded carbon chain elongation, (b) enzymatically forming a first terminal functional group selected from carboxyl, amine, formyl, and hydroxyl groups in said backbone while maintaining said methyl ester shield for at least one further enzymatic step, and (c) enzymatically forming a second terminal functional group selected from carboxyl, amine, formyl, and hydroxyl groups in said backbone, thereby forming said difunctional product. In some embodiments, the number of carbon atoms in the backbone may be any of five, seven, nine, eleven, thirteen, fifteen, seventeen, or nineteen carbon atoms.

Following one, two, three, four, five, six, seven, or eight cycles of methyl ester shielded carbon chain elongation, the following aliphatic backbones may be formed: pentanedioyl-[acp]methyl ester or pentanedioyl-CoA methyl ester; heptanedioyl-[acp] methyl ester or heptanedioyl-CoA methyl ester; nonanedioyl-[acp] methyl ester or nonanedioyl-CoA methyl ester; undecanedioyl-[acp] methyl ester or undecanedioyl-CoA methyl ester; tridecanedioyl-[acp] methyl ester or tridecanedioyl-CoA methyl ester; pentadecanedioyl-[acp] methyl ester or pentadecanedioyl-CoA methyl ester; heptadecanedioyl-[acp] methyl ester or heptadecanedioyl-CoA methyl ester; or nonadecanedioyl-[acp] methyl ester or nonadecanedioyl-CoA methyl ester.

Each of the aforementioned aliphatic backbones can be converted to the respective central precursor, namely pentanedioyl-[acp] or pentanedioyl-CoA, heptanedioyl-[acp] or heptanedioyl-CoA, nonanedioyl-[acp] or nonanedioyl-CoA, undecanedioyl-[acp] or undecanedioyl-CoA, tridecanedioyl-[acp] or tridecanedioyl-CoA, pentadecanedioyl-[acp] or pentadecanedioyl-CoA, heptadecanedioyl-[acp] or heptadecanedioyl-CoA, nonanedecanedioyl-[acp] or nonadecanedioyl-CoA by a polypeptide having the activity of [acp] methyl ester esterase classified, for example, under EC 3.1.1.85, such as the gene product of bioH, from, for example *Escherichia coli* (see UniProtKB Accession No. P13001 (SEQ ID NO: 139). However, some analyses indicate that a thioesterase may bypass the activity of BioH and instead produce a monomethyl carboxylate and holo-[ACP] or holo-CoA (see, e.g., FIG. 36). Since BioH may show low activity towards monomethyl carboxylate, this process may lead to a decrease in carboxylate production. In some embodiments, the method comprises synthesizing an aliphatic carbon chain backbone via one or more cycles of methyl ester shielded carbon chain elongation in a bioH deficient background. In some embodiments, the method comprises a step of downregulating the activity of bioH. For example, in some embodiments, the method is performed in a recombinant host comprising a deletion in bioH. In some embodiments, the recombinant host does not express BioH.

In any of these embodiments, after the one or more cycles of carbon chain elongation, the methyl ester shield may be maintained for at least one further enzymatic step. In some embodiments, the at least one further enzymatic step comprises the enzymatic conversion of methyl ester intermediates to the respective monomethyl carboxylate.

Therefore, in some embodiments, the resulting pentanedioyl-[acp] methyl ester or pentanedioylCoA methyl ester, heptanedioyl-[acp] methyl ester or heptanedioyl-CoA methyl ester, nonanedioyl-[acp] methyl ester or nonanedioyl-CoA methyl ester, undecanedioyl-[acp]methyl ester or undecanedioyl-CoA methyl ester, tridecanedioyl-[acp] methyl ester or tridecanedioyl-CoA methyl ester, pentadecanedioyl-[acp] methyl ester or pentadecanedioyl-CoA methyl ester, heptadecanedioyl-[acp] methyl ester or heptadecanedioyl-CoA methyl ester, or nonadecanedioyl-[acp] methyl ester or nonadecanedioyl-CoA methyl ester can be further converted to the respective monomethyl carboxylate by a polypeptide having the activity of thioesterase classified, for example, under EC 3.1.1.2, EC 3.1.1.5, or EC 3.1.2.-, such as EC 3.1.2.14, EC 3.1.2.21, or EC 3.1.2.27.

In one aspect, pentanedioyl-[acp] methyl ester or pentanedioyl-CoA methyl ester can be converted to monomethyl pentanedioate; heptanedioyl-[acp] methyl ester or heptanedioyl-CoA methyl ester to monomethyl heptanedioate; nonanedioyl-[acp] methyl ester or nonanedioyl-CoA methyl ester to monomethyl nonanedioate; undecanedioyl-[acp] methyl ester or undecanedioyl-CoA methyl ester to monomethyl undecanedioate; tridecanedioyl-[acp] methyl ester or tridecanedioyl-CoA methyl ester to monomethyl tridecanedioate; pentadecanedioyl-[acp] methyl ester or pentadecanedioyl-CoA methyl ester to monomethyl pentadecanedioate; heptadecanedioyl-[acp] methyl ester or heptadecanedioyl-CoA methyl ester to monomethyl heptadecanedioate; and nonadecanedioyl-[acp] methyl ester or nonadecanedioyl-CoA methyl ester to monomethyl nonadecanedioate.

In some embodiments, the at least one further enzymatic step comprises the enzymatic conversion of a monomethyl carboxylate to a monomethyl carboxylate semialdehyde. In some embodiments, the at least one further enzymatic step comprises the enzymatic conversion of monomethyl pentanedioate to methyl 5-oxopentanoate; the enzymatic conversion of monomethyl heptanedioate to methyl 7-oxoheptanoate; the enzymatic conversion of monomethyl nonanedioate to methyl 9-oxononanoate; the enzymatic conversion of monomethyl undecanedioate to methyl 11-oxoundecanoate; the enzymatic conversion of monomethyl tridecanedioate to methyl 13-oxotridecanoate; the enzymatic conversion of monomethyl pentadecanedioate to methyl 15-oxopentadecanoate; the enzymatic conversion of monomethyl heptadecanedioate to methyl 17-oxoheptadecanoate; or the enzymatic conversion of monomethyl nonadecanedioate to methyl 19-oxononadecanoate.

In some embodiments, the at least one further enzymatic step comprises the enzymatic conversion of a monomethyl carboxylate semialdehyde to a monomethyl aminocarboxylate. In some embodiments, the at least one further enzymatic step comprises the enzymatic conversion of methyl 5-oxopentanoate to monomethyl 5-aminopentanoate; methyl 7-oxoheptanoate to monomethyl 7-aminoheptanoate; methyl 9-oxononanoate to monomethyl 9-aminononanoate; methyl 11-oxoundecanoate to monomethyl 11-aminoundecanoate; methyl 13-oxotridecanoate to monomethyl 13-aminotridecanoate; methyl 15-oxopentadecanoate to monomethyl 15-aminopentadecanoate; methyl 17-oxoheptadecanoate to monomethyl 17-aminoheptadecanoate; or methyl 19-oxononadecanoate to monomethyl 19-aminononadecanoate.

In some embodiments, the at least one further enzymatic step comprises the enzymatic conversion of the aliphatic carbon chain backbone to a monomethyl carboxylate semialdehyde. In some embodiments, the following enzymatic conversions may occur: pentanedioyl-[acp]methyl ester or pentanedioyl-CoA methyl ester can be converted to methyl 5-oxopentanoate; heptanedioyl-[acp] methyl ester or heptanedioyl-CoA methyl ester to methyl 7-oxoheptanoate; nonanedioyl-[acp] methyl ester or nonanedioyl-CoA methyl ester to methyl 9-oxononanoate; undecanedioyl-[acp] methyl ester or undecanedioyl-CoA methyl ester to methyl 11-oxoundecanoate; tridecanedioyl-[acp] methyl ester or tridecanedioyl-CoA methyl ester to methyl 13-oxotridecanoate; pentadecanedioyl-[acp] methyl ester or pentadecanedioyl-CoA methyl ester to methyl 15-oxopentadecanoate; heptadecanedioyl-[acp] methyl ester or heptadecanedioyl-CoA methyl ester to methyl 17-oxoheptadecanoate; and nonadecanedioyl-[acp] methyl ester or nonadecanedioyl-CoA methyl ester to methyl 19-oxononadecanoate.

In some embodiments, a monomethyl carboxylate can be converted to the respective dicarboxylic acid using an esterase. In an embodiment, the following enzymatic conversions may occur: monomethyl pentanedioate to pentanedioic acid; monomethyl heptanedioate to heptanedioic acid; monomethyl nonanedioate to nonanedioic acid; monomethyl undecanedioate to undecanedioic acid; monomethyl tridecanedioate to tridecanedioic acid; monomethylpentadecanoate to pentadecanedioic acid; monomethyl heptadecanedioate to heptadecanedioic acid, and monomethyl nonadecanedioate to nonadecanedioic acid.

In some embodiments, the monomethyl carboxylate semialdehyde can be converted to a carboxylate semialdehyde using a polypeptide having the activity of an esterase. In some embodiments, the following enzymatic conversions may occur: methyl 5-oxopentanoate to 5-oxopentanoate; methyl 7-oxoheptanoate to 7-oxoheptanoate; methyl 9-oxononanoate to 9-oxononanoate; methyl 11-oxoundecanoate to 11-oxoundecanoate; methyl 13-oxotridecanoate to 13-oxotridecanoate; methyl 15-oxopentadecanoate to 15-oxopentadecanoate; methyl 17-oxoheptadecanoate to 17-oxoheptadecanoate and methyl 19-oxononadecanoate to 19-oxononadecanoate.

In some embodiments, a monomethyl aminocarboxylate can be converted to an aminocarboxylate using a polypeptide having the activity of an esterase. In some embodiments, the following enzymatic conversions may occur: monomethyl aminopentanoate to 5-aminopentanoate; monomethyl aminoheptanoate to 7-aminoheptanoate; monomethyl aminononanoate to 9-aminononanoate; monomethyl aminoundecanoate to 11-aminoundecanoate; monomethyl aminotridecanoate to 13-aminotridecanoate; monomethyl aminopentadecanoate to 15-aminopentadecanoate; monomethyl aminoheptadecanoate to 17-aminoheptadecanoate, or monomethyl aminononadecanoate to 19-aminononadecanoate.

A dicarboxylic acid derived from a monomethyl carboxylate by the enzymatic activity of an esterase may itself be converted to a carboxylate semialdehyde, which may subsequently be converted in a further enzymatic step to an aminocarboxylate. In some embodiments, the following enzymatic conversions may occur: pentanedioic acid to 5-oxopentanoate to 5-aminopentanoate; heptanedioic acid to 7-oxoheptanoate to 7-aminoheptanoate; nonanedioic acid to 9-oxononanoate to 9-aminononanoate; undecanedioic acid to 11-oxoundecanoate to 11-aminoundecanoate; tridecanedioic acid to 13-oxotridecanoate to 13-aminotridecanoate; pentadecanedioic acid to 15-oxopentadecanoate to 15-aminopentadecanoate; heptadecanedioic acid to 17-oxoheptadecanoate to 17-aminoheptadecanoate; or nonadecanedioic acid to 19-oxononadecanoate to 19-aminononadecanoate.

In some embodiments, an aminocarboxylate may be converted to an acetamidocarboxylate. In some embodiments, the following enzymatic conversions may occur: 5-aminopentanoate to N5-acetyl-5-aminopentanoate; 7-aminoheptanoate to N7-acetyl-7-aminoheptanoate; 9-aminononanoate to N9-acetyl-9-aminononanoate; 11-aminoundecanoate to N11-acetyl-11-aminoundecanoate; 13-aminotridecanoate to N13-acetyl-13-aminotridecanoate; 15-aminopentadecanoate to N15-acetyl-15-aminopentadecanoate; 17-aminoheptadecanoate to N17-acetyl-17-aminoheptadecanoate; or 19-aminononadecanoate to N19-acetyl-19-aminononadecanoate.

In some embodiments, an acetamidocarboxylate may be converted to a diamine. For example, in some embodiments, an acetamidocarboxylate may be converted to an acetamidoaldehyde, followed by conversion to an acetamidoamine, followed by conversion to a diamine. In some embodiments, the following enzymatic conversions may occur: N5-acetyl-5-aminopentanoate to N5-acetyl-5-aminopentanal to N5-acetyl-1,5-diaminopentane to pentane-1,5-diamine; N7-acetyl-7-aminoheptanoate to N7-acetyl-7-aminoheptanal to N7-acetyl-1,7-diaminoheptane to heptane-1,7-diamine; N9-acetyl-9-aminononanoate to N9-acetyl-9-aminononanal to N9-acetyl-1,9-diaminonoane to nonane-1,9-diamine; N11-acetyl-11-aminoundecanoate to N11-acetyl-11-aminoundecanal to N11-acetyl-1,11-diaminoundecane to undecane-1,11-diamine; N13-acetyl-13-aminotridecanoate to N13-acetyl-13-aminotridecanal to N13-acetyl-1,13-diaminotridecane to tridecane-1,13-diamine; N15-acetyl-15-aminopentadecanoate to N15-acetyl-15-aminopentadecanal to N15-acetyl-1,15-diaminopentadecane to pentadecane-1,15-diamine; N17-acetyl-17-aminoheptadecanoate to N17-acetyl-17-aminoheptadecanal to N17-acetyl-1,17-diaminoheptadecane to heptadecane-1,17-diamine; or N19-acetyl-19-aminononadecanoate to N19-acetyl-19-aminononadecanal to N19-acetyl-1,19-diaminononadecane to nonadecane-1,19-diamine.

In some embodiments, a carboxylate semialdehyde may be converted to a hydroxycarboxylate. In some embodiments, the following enzymatic conversions may occur: pentanoate semialdehdye to 5-hydroxypentanoate; 7-oxoheptanoate to 7-hydroxyheptanoate; 9-oxononanoate to 9-hydroxynonanoate; 11-oxoundecanoate to 11-hydroxyundecanoate; 13-oxotridecanoate to 13-hydroxytridecanoate; 15-oxopentadecanoate to 15-hydroxypentadecanoate; 17-oxoheptadecanoate to 17-hydroxyheptadecanoate, or 19-oxononadecanoate to 19-hydroxynonadecanoate.

In some embodiments, a hydroxycarboxylate may be converted to a dial. In some embodiments, the following enzymatic conversions may occur: 5-hydroxypentanoate to 1,5-pentanedial; 7-hydroxyheptanoate to 1,7-heptanedial; 9-hydroxynonanoate to 1,9-nonanedial; 11-hydroxyundecanoate to 1,11-undecanedial; 13-hydroxytridecanoate to 1,13-tridecanedial; 15-hydroxypentadecanoate to 1,15-pentadecanedial; 17-hydroxyheptadecanoate to 1,17-heptadecanedial; or 19-hydroxynonadecanoate to 1,19-nonadecanedial.

In some embodiments, a dial may be converted to an aminoaldehyde. In some embodiments, the following enzymatic conversions may occur: 1,5-pentanedial to 5-aminopentanal; 1,7-heptanedial to 7-aminoheptanal; 1,9-nonanedial to 9-aminononanal; 1,11-undecanedial to 11-aminoundecanal; 1,13-tridecanedial to 13-aminotridecanal; 1,15-pentadecanedial to 15-aminopentadecanal; 1,17-heptadecanedial to 17-aminoheptadecanal; or 1,19-nonadecanedial to 19-aminononadecanal.

In some embodiments, an aminoaldehyde may be converted to a diamine. In some embodiments, the following enzymatic conversions may occur: 5-aminopentanal to pentane-1,5-diamine; 7-aminoheptanal to heptane-1,7-diamine; 9-aminononanal to nonane-1,9-diamine; 11-aminoundecanal to undecane-1,11-diamine; 13-aminotridecanal to tridecane-1,13-diamine; 15-aminotridecanal to tridecane-1,13-diamine; 15-aminopentadecanal to pentadecane-1,15-diamine; 17-aminoheptadecanal to heptadecane-1,17-diamine; or 19-aminononadecanal to nonadecane-1,19-diamine.

In some embodiments, a hydroxycarboxylate may be converted to a hydroxyaldehyde. In some embodiments, the following enzymatic conversions may occur: 5-hydroxypentanoate to 5-hydroxypentanal; 7-hydroxyheptanoate to 7-hydroxyheptanal; 9-hydroxynonanoate to 9-hydroxynonanal; 11-hydroxyundecanoate to 11-hydroxyundecanal; 13-hydroxytridecanoate to 13-hydroxytridecanal; 15-hydroxypentadecanoate to 15-hydroxypentadecanal; 17-hydroxyheptadecanoate to 17-hydroxyheptadecanal; or 19-hydroxynonadecanoate to 19-hydroxynonadecanal.

In some embodiments, a hydroxyaldehyde may be converted to a diol. In some embodiments, the following enzymatic conversions may occur: 5-hydroxypentanal to 1,5-pentanediol; 7-hydroxyheptanal to 1,7-heptanediol; 9-hydroxynonanal to 1,9-nonanediol; 11-hydroxyundecanal to 1,11-undecanediol; 13-hydroxytridecanal to 1,13-tridecanediol; 15-hydroxypentadecanal to 1,15-pentadecanediol; 17-hydroxyheptadecanal to 1,17-heptadecanediol; or 19-hydroxynonadecanal to 1,19-nonadecanediol.

In some embodiments, a hydroxyaldehyde may be converted to a hydroxyamine. In some embodiments, the following enzymatic conversions may occur: 5-hydroxypentanal to 5-aminopentanol; 7-hydroxyheptanal to 7-aminoheptanol; 9-hydroxynonanal to 9-aminononanol; 11-hydroxyundecanal to 11-aminoundecanol; 13-hydroxytridecanal to 13-aminotridecanol; 15-hydroxypentadecanal to 15-aminopentadecanol; 17-hydroxyheptadecanal to 17-aminoheptadecanol; or 19-hydroxynonadecanal to 19-aminononadecanol.

In some embodiments, a hydroxyamine may be converted to an aminoaldehyde. In some embodiments, the following enzymatic conversions may occur: 5-aminopentanol to 5-aminopentanal; 7-aminoheptanol to 7-aminoheptanal; 9-aminononanol to 9-aminononanal; 11-aminoundecanol to 11-aminoundecanal; 13-aminotridecanol to 13-aminotridecanal; 15-aminopentadecanol to 15-aminopentadecanal; 17-aminoheptadecanol to 17-aminoheptadecanal; or 19-aminononadecanol to 19-aminoheptadecanal.

In some embodiments, the method comprises (a) enzymatically synthesizing an aliphatic backbone having an odd number of carbons from (i) acetyl-CoA and propanedioyl-CoA via one or more cycles of methyl ester shielded carbon chain elongation or (ii) propanedioyl-[acp] via one or more cycles of methyl ester shielded carbon chain elongation, and maintaining the methyl ester shield for at least one further enzymatic step following the one or more cycles of carbon chain elongation, and (b) enzymatically forming two terminal functional groups selected from carboxyl, formyl, amine, and hydroxyl groups in the backbone, thereby forming the difunctional product, and wherein the method comprises a step of downregulating the activity of metJ, a methionine repressor protein that inhibits the initial step of adding a methyl ester shield to propanedioyl-CoA or propanedioyl-[acp]. For example, in some embodiments, the method is performed in a recombinant host comprising a deletion in metJ. In some embodiments, the recombinant host does not express MetJ.

In some embodiments, the aliphatic backbone having an odd number of carbon atoms is a five to nineteen carbon chain aliphatic backbone.

One advantage of performing a method according to this disclosure is that, in a bioH deficient background, the carboxyl-[acp] methyl ester or the carboxyl-CoA methyl ester can be converted to the respective monomethyl carboxylate, the respective monomethyl carboxylate semialdehyde, and/or the respective monomethyl aminocarboxylate. Such methyl ester shielded building blocks (i.e., methyl ester shielded $C_5$-$C_{19}$ building blocks) may be further converted to a carboxylic acid, carboxylate semialdehyde, or aminocarboxylate by a suitable esterase with high efficiency, which may ultimately lead to higher yields of difunctional products having an odd number of carbon atoms.

A five to nineteen carbon chain aliphatic backbone according to this disclosure can be any of pentanedioyl-[acp] methyl ester or pentanedioyl-CoA methyl ester; heptanedioyl-[acp]methyl ester or heptanedioyl-CoA methyl ester; nonanedioyl-[acp] methyl ester or nonanedioyl-CoA methyl ester; undecanedioyl-[acp] methyl ester or undecanedioyl-CoA methyl ester; tridecanedioyl-[acp] methyl ester or tridecanedioyl-CoA methyl ester; pentadecanedioyl-[acp] methyl ester or pentadecanedioyl-CoA methyl ester; heptadecanedioyl-[acp] methyl ester or heptadecanedioyl-CoA methyl ester or nonadecanedioyl-[acp] methyl ester or nonadecanedioyl-CoA methyl ester.

In some embodiments, a polypeptide having the activity of S-adenosyl-L-methionine (SAM)-dependent methyltransferase can convert propanedioyl-CoA to a propanedioyl-CoA methyl ester or can convert propanedioyl-[acp] to a propanedioyl-[acp] methyl ester. Each of the one or more cycles of methyl ester shielded carbon chain elongation can include using polypeptides having the activity of one or more (i) a β-ketoacyl-[acp] synthase or β-ketothiolase, (ii) a 3-oxoacyl-[acp] reductase, acetoacetyl-CoA reductase, a 3-hydroxyacyl-CoA dehydrogenase or a 3-hydroxybutyryl-CoA dehydrogenase, (iii) an enoyl-CoA hydratase or a 3-hydroxyacyl-[acp] dehydratase, and (iv) an enoyl-[acp] reductase or a trans-2-enoyl-CoA reductase to produce heptanedioyl-[acp] methyl ester from propanedioyl-[acp] methyl ester or produce heptanedioyl-CoA methyl ester from propanedioyl-CoA methyl ester.

According to the present disclosure, the methyl group is not removed from the carboxyl-CoA methyl ester or the carboxyl-[acp] methyl ester following the one or more cycles of carbon chain elongation without at least one further enzymatic step.

In some embodiments, a polypeptide having the activity of S-adenosyl-L-methionine (SAM)-dependent methyltransferase can add an initial methyl ester shield to propanedioyl-CoA to form propanedioyl-CoA methyl ester or propanedioyl-[acp] to form propanedioyl-[acp]methyl ester. The polypeptide having the activity of S-adenosyl-L-methionine (SAM)-dependent methyltransferase can have at least 50%, at least 60%, at least 70%, or at least 85% sequence identity or homology to the amino acid sequence of SEQ ID NO: 52.

A polypeptide having the activity of an esterase can remove a methyl shield from the methyl-protected $C_{2n+3}$ building blocks, wherein n is an integer greater than or equal to one (i.e., $C_5$-$C_{19}$ building blocks), such as monomethyl carboxylate, monomethyl carboxylate semialdehyde, and monomethyl aminocarboxylate. A polypeptide having the activity of an esterase can have at least 50%, at least 60%, at least 70%, or at least 85% sequence identity or homology to the amino acid sequence of SEQ ID NO: 50 or SEQ ID NO: 51.

The two terminal functional groups can be the same (e.g., amine, formyl, carboxyl, or hydroxyl groups) or can be different (e.g., a terminal amine and a terminal carboxyl group; or a terminal hydroxyl group and a terminal carboxyl group).

A polypeptide having the activity of an aminotransferase or a deacetylase can enzymatically form an amine group. A polypeptide having the activity of an aminotransferase can have at least 50%, at least 60%, at least 70%, or at least 85% sequence identity or homology to the amino acid sequence of any one of SEQ ID NOs: 116-138 or SEQ ID NOs: 167-181. A polypeptide having the activity of a deacetylase can have at least 50%, at least 60%, at least 70%, or at least 85% sequence identity or homology to the amino acid sequence of any one of SEQ ID NOs: 42-45.

A polypeptide having the activity of 6-hydroxyhexanoate dehydrogenase, 5-hydroxypentanoate dehydrogenase, 4-hydroxybutyrate dehydratase, or alcohol dehydrogenase can enzymatically form a hydroxyl group.

A polypeptide having an activity selected from thioesterase, esterase, aldehyde dehydrogenase, 7-oxoheptanoate dehydrogenase, 6-oxohexanoate dehydrogenase, CoA-transferase (e.g. glutaconate CoA transferase), and reversible CoA-ligase (e.g., reversible succinate-CoA ligase) can enzymatically form a terminal carboxyl group. A polypeptide having the activity of a thioesterase can have at least 50%, at least 60%, at least 70%, or at least 85% sequence identity or homology to the amino acid sequence of any one of SEQ ID NOs: 58-113 or SEQ ID NOs: 182-195.

A polypeptide having the activity of a carboxylate reductase and a polypeptide having the activity of a phosphopantetheinyl transferase can form a terminal aldehyde group as an intermediate in forming the product. A polypeptide having the activity of a carboxylate reductase can have at least 50%, at least 60%, at least 70%, or at least 85% sequence identity or homology to the amino acid sequence of any one of SEQ ID NOs: 25-39 or SEQ ID NOs: 196-215.

Any of the methods described herein can be performed in a recombinant host by fermentation. The host can be subjected to a cultivation strategy under aerobic, anaerobic, micro-aerobic or mixed oxygen/denitrification cultivation conditions. The host can be cultured under conditions of nutrient limitation. The host can be retained using a ceramic hollow fiber membrane to maintain a high cell density during fermentation.

In some embodiments, a cultivation strategy is used to achieve anaerobic, micro-aerobic, or aerobic cultivation conditions.

In some embodiments, the cultivation strategy includes limiting nutrients, such as limiting nitrogen, phosphate, or oxygen.

In any of the methods, the host's tolerance to high concentrations of a difunctional product having an odd number of carbon atoms, such as a $C_5$-$C_{19}$ building block, can be improved through continuous cultivation in a selective environment.

In some embodiments, the host may comprise a deletion in bioH. In some embodiments, the host does not express BioH. In some embodiments, the host may comprise a deletion in metJ. In some embodiments, the host does not express MetJ.

The principal carbon source fed to the fermentation can derive from biological or non-biological feedstocks. In some embodiments, the biological feedstock is, includes, or derives from, monosaccharides, disaccharides, lignocellulose, hemicellulose, cellulose, lignin, levulinic acid and formic acid, triglycerides, glycerol, fatty acids, agricultural waste, condensed distillers' solubles, or municipal waste. In some embodiments, the feedstock is not glucose.

In some embodiments, the non-biological feedstock is or derives from natural gas, syngas, $CO_2/H_2$, methanol, ethanol, benzoate, non-volatile residue (NVR) or a caustic wash waste stream from cyclohexane oxidation processes, or a terephthalic acid/isophthalic acid mixture waste stream.

This document also features a recombinant host that includes at least one exogenous nucleic acid encoding one or more of: (i) an S-adenosyl-L-methionine (SAM)-dependent methyltransferase, (ii) a β-ketoacyl-[acp] synthase or a β-ketothiolase, (iii) a 3-oxoacyl-[acp] reductase, acetoacetyl-CoA reductase, a 3-hydroxyacyl-CoA dehydrogenase or a 3-hydroxybutyryl-CoA dehydrogenase, (iv) an enoyl-CoA hydratase or 3-hydroxyacyl-[acp] dehydratase, and (v) an enoyl-[acp] reductase or a trans-2-enoyl-CoA reductase, said host producing a carboxyl-[acp] methyl ester or a carboxyl-CoA methyl ester.

A recombinant host producing a carboxyl-[acp] methyl ester or a carboxyl-CoA methyl ester can further comprise at least one exogenous nucleic acid encoding one or more of an esterase, a thioesterase, an aldehyde dehydrogenase, a 7-oxoheptanoate dehydrogenase, a 6-oxohexanoate dehydrogenase, a glutaconate CoA-transferase, a reversible succinyl-CoA ligase, an acetylating aldehyde dehydrogenase, or a carboxylate reductase, said host producing a carboxylic acid, a monomethyl carboxylate, a carboxylate semialdehyde or a monomethyl carboxylate semialdehyde.

A recombinant host producing a carboxylate semialdehyde can further comprise at least one exogenous nucleic acid encoding an aminotransferase, said host producing an aminocarboxylate.

A recombinant host producing a monomethyl carboxylate semialdehyde further can include at least one exogenous nucleic acid encoding an esterase, said host producing a carboxylate semialdehyde.

A recombinant host producing monomethyl carboxylate further can include at least one exogenous nucleic acid encoding an esterase, said host producing a dicarboxylic acid.

A recombinant host producing monomethyl carboxylate further can include at least one exogenous nucleic acid encoding a carboxylate reductase, optionally in combination with a phosphopantetheine transferase enhancer, said host producing a monomethyl carboxylate semialdehyde.

A recombinant host producing monomethyl carboxylate semialdehyde further can comprise at least one exogenous nucleic acid encoding an aminotransferase, and/or at least one exogenous nucleic acid encoding an esterase, said host producing an aminocarboxylate.

A recombinant host producing carboxylate semialdehyde further can comprise at least one exogenous nucleic acid encoding a 4-hydroxybutyrate dehydrogenase, a 5-hydroxypentanoate dehydrogenase, or a 6-hydroxyhexanoate dehydrogenase, said host producing a hydroxycarboxylate.

A recombinant host producing monomethyl carboxylate semialdehyde further can include at least one exogenous nucleic acid encoding an esterase, and/or a 4-hydroxybutyrate dehydrogenase, a 5-hydroxypentanoate dehydrogenase or a 6-hydroxyhexanoate dehydrogenase, said host producing a hydroxycarboxylate.

A recombinant host producing carboxylate semialdehyde, an aminocarboxylate, or a hydroxycarboxylate acid further can comprise at least one exogenous nucleic acid encoding a carboxylate reductase, an aminotransferase, a deacetylase, an N-acetyl transferase, or an alcohol dehydrogenase, said host producing a diamine.

A recombinant host producing a hydroxycarboxylate further can further comprise at least one exogenous nucleic acid encoding a carboxylate reductase or an alcohol dehydrogenase, said host producing a diol.

A recombinant host producing an aminocarboxylate further can include at least one exogenous nucleic acid encoding a carboxylate reductase or an alcohol dehydrogenase, the host producing an aminoaldehyde.

The recombinant host can be a prokaryote, e.g., from the genus *Escherichia* such as *Escherichia coli*; from the genus *Clostridia* such as *Clostridium ljungdahlii*, *Clostridium autoethanogenum* or *Clostridium kluyveri*; from the genus Corynebacteria such as *Corynebacterium glutamicum*; from the genus *Cupriavidus* such as *Cupriavidus* necator or *Cupriavidus metallidurans*; from the genus *Pseudomonas* such as *Pseudomonas fluorescens*, *Pseudomonas putida* or *Pseudomonas* oleavorans; from the genus Delftia *acidovorans*; from the genus *Bacillus* such as *Bacillus* subtillis; from the genes *Lactobacillus* such as *Lactobacillus delbrueckii*; from the genus *Lactococcus* such as *Lactococcus lactis*; or from the genus *Rhodococcus* such as *Rhodococcus equi*. In some embodiments, the host is not *Escherichia coli*.

The recombinant host can be a eukaryote, e.g., a eukaryote from the genus *Aspergillus* such as *Aspergillus niger*; from the genus *Saccharomyces* such as *Saccharomyces cerevisiae*; from the genus *Pichia* such as *Pichia pastoris*; from the genus *Yarrowia* such as *Yarrowia lipolytica*, from the genus *Issatchenkia* such as *Issathenkia orientalis*, from the genus *Debaryomyces* such as *Debaryomyces hansenii*, from the genus *Arxula* such as *Arxula adenoinivorans*, or from the genus *Kluyveromyces* such as *Kluyveromyces lactis*.

Any of the recombinant hosts described herein further can comprise one or more of the following attenuated enzymes: polyhydroxyalkanoate synthase, an acetyl-CoA thioesterase, an acetyl-CoA specific β-ketothiolase, a phosphotransacetylase forming acetate, an acetate kinase, a lactate dehydrogenase, a menaquinol-fumarate oxidoreductase, a 2-oxoacid decarboxylase producing isobutanol, an alcohol dehydrogenase forming ethanol, a triose phosphate isomerase, a pyruvate decarboxylase, a glucose-6-phosphate isomerase, a transhydrogenase dissipating the NADH or NADPH imbalance, an glutamate dehydrogenase dissipating the NADH or NADPH imbalance, a NADH/NADPH-utilizing glutamate dehydrogenase, a pimeloyl-CoA dehydrogenase; an acyl-CoA dehydrogenase accepting C7 building blocks and central precursors as substrates; a glutaryl-CoA dehydrogenase; and/or apimeloyl-CoA synthetase.

As used herein, "attenuation" refers to downregulation or inactivation of gene expression.

Any of the recombinant hosts described herein further can overexpress one or more genes encoding: an acetyl-CoA synthetase, a 6-phosphogluconate dehydrogenase; a transketolase; a puridine nucleotide transhydrogenase; a formate dehydrogenase; a glyceraldehyde-3P-dehydrogenase; a malic enzyme; a glucose-6-phosphate dehydrogenase; a fructose 1,6 diphosphatase; a L-alanine dehydrogenase; a L-glutamate dehydrogenase specific to the NADH or NADPH used to generate a co-factor imbalance; a methanol dehydrogenase, a formaldehyde dehydrogenase, a diamine transporter; a dicarboxylate transporter; an S-adenosylmethionine synthetase; and/or a multidrug transporter.

Any of the recombinant hosts described herein may comprise a deletion in bioH. In some embodiments, the recombinant host does not express BioH. In some embodiments, the recombinant host may comprise a deletion in metJ. In some embodiments, the recombinant host does not express MetJ.

The reactions of the pathways described herein can be performed in one or more cell (e.g., host cell) strains (a) naturally expressing one or more relevant enzymes, (b) genetically engineered to express one or more relevant enzymes, or (c) naturally expressing one or more relevant enzymes and genetically engineered to express one or more relevant enzymes. Alternatively, relevant enzymes can be extracted from any of the above types of host cells and used in a purified or semi-purified form. Extracted enzymes can optionally be immobilized to a solid substrate such as the floors and/or walls of appropriate reaction vessels. Moreover, such extracts include lysates (e.g. cell lysates) that can be used as sources of relevant enzymes. In the methods provided by the document, all the steps can be performed in cells (e.g., host cells), all the steps can be performed using extracted enzymes, or some of the steps can be performed in cells and others can be performed using extracted enzymes.

Many of the enzymes described herein catalyze reversible reactions, and the reaction of interest may be the reverse of the described reaction. The schematic pathways shown in FIGS. 1-8 illustrate reactions of interest for each of the intermediates, wherein n cycles of methyl ester shielded carbon chain elongation occur, wherein n is an integer greater than or equal to one. Example schematics shown in FIGS. 33-40 are specific to $C_7$ (n=2).

In some embodiments, the host microorganism's endogenous biochemical network is attenuated or augmented to (1) ensure the intracellular availability of 2-oxoglutarate and 2-oxoadipate, (2) create an $NAD^+$ imbalance that may only be balanced via the formation of a difunctional product having an odd number of carbon atoms (i.e., a $C_5$-$C_{19}$ building block), (3) prevent degradation of central metabolites, central precursors leading to and including difunctional products having an odd number of carbon atoms (i.e., $C_5$-$C_{19}$ building blocks) and (4) ensure efficient efflux from the cell.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and the drawings, and from the claims. The word "comprising" in the claims may be replaced by "consisting essentially of" or with "consisting of," according to standard practice in patent law.

Embodiments of the disclosure include:
1. A method for biosynthesizing a difunctional product having an odd number of carbon atoms in vitro or in a recombinant host, said method comprising:
    enzymatically synthesizing an aliphatic carbon chain backbone having an odd number of carbon atoms from (i) acetyl-CoA and propanedioyl-CoA via one or more cycles of methyl ester shielded carbon chain elongation or (ii) propanedioyl-[acp] via one or more cycles of methyl ester shielded carbon chain elongation;
    enzymatically forming a first terminal functional group selected from carboxyl, amine, formyl, and hydroxyl groups in said backbone while maintaining said methyl ester shield for at least one further enzymatic step; and
    enzymatically forming a second terminal functional group selected from carboxyl, amine, formyl, and hydroxyl groups in said backbone, thereby forming said difunctional product.
2. The method of embodiment 1, wherein each of said one or more cycles of carbon chain elongation comprises using (i) a polypeptide having the activity of a β-ketoacyl-[acp] synthase or a β-ketothiolase, (ii) a polypeptide having the activity of a 3-oxoacyl-[acp] reductase, an acetoacetyl-CoA reductase, a 3-hydroxyacyl-CoA dehydrogenase, or a 3-hydroxybutyryl-CoA dehydrogenase, (iii) an enoyl-CoA hydratase or a 3-hydroxyacyl-[acp] dehydratase, and (iv) an enoyl-[acp] reductase or a trans-2-enoyl-CoA reductase.
3. The method of embodiments 1 or 2, wherein said difunctional product has at least five carbon atoms.
4. The method of embodiment 3, wherein said difunctional product has five, seven, nine, eleven, thirteen, fifteen, seventeen, or nineteen carbon atoms.
5. The method of embodiment 3, wherein said difunctional product has five, seven, nine, seventeen, or nineteen carbon atoms.
6. The method of embodiment 1, wherein said aliphatic carbon chain backbone is i) pentanedioyl-[acp] methyl ester or pentanedioyl-CoA methyl ester, ii) heptanedioyl-[acp] methyl ester or heptanedioyl-CoA methyl ester, iii) nonanedioyl-[acp] methyl ester or nonanedioyl-CoA methyl ester, iv) undecanedioyl-[acp] methyl ester or undecanedioyl-CoA methyl ester, v) tridecanedioyl-[acp] methyl ester or tridecanedioyl-CoA methyl ester, vi) pentadecanedioyl-[acp] methyl ester or pentadecanedioyl-CoA methyl ester, vii) heptadecanedioyl-[acp] methyl ester or heptadecanedioyl-CoA methyl ester, or viii) nonadecanedioyl-[acp] methyl ester or nonadecanedioyl-CoA methyl ester.
7. The method of any one of embodiments 1 to 6, wherein a polypeptide having the activity of a S-adenosyl-L-methionine (SAM)-dependent methyltransferase converts propanedioyl-CoA to propanedioyl-CoA methyl ester or converts propanedioyl-[acp] to propanedioyl-[acp] methyl ester before said one or more cycles of methyl ester shielded carbon chain elongation.
8. The method of embodiment 7, wherein the polypeptide having the activity of a S-adenosyl-L-methionine (SAM)-dependent methyltransferase has at least 50%, at least 60%, at least 70%, or at least 85% sequence homology to the amino acid sequence of SEQ ID NO: 52.
9. The method of any one of embodiments 1 to 6, wherein said at least one further enzymatic step comprises the enzymatic conversion of said aliphatic carbon chain backbone to a monomethyl carboxylate.
10. The method of embodiment 9, wherein said at least one further enzymatic step also produces holo-ACP or holo-CoA.
11. The method of embodiment 9, wherein said at least one further enzymatic step comprises the enzymatic conversion of pentanedioyl-[acp] methyl ester to monomethyl pentanedioate or pentanedioyl-CoA methyl ester to monomethyl pentanedioate.
12. The method of embodiment 9, wherein said at least one further enzymatic step comprises the enzymatic conversion of heptanedioyl-[acp] methyl ester to monomethyl heptanedioate or heptanedioyl-CoA methyl ester to monomethyl heptanedioate.
13. The method of embodiment 9, wherein said at least one further enzymatic step comprises the enzymatic conversion of nonanedioyl-[acp] methyl ester to monomethyl nonanedioate or nonanedioyl-CoA methyl ester to monomethyl nonanedioate.
14. The method of embodiment 9, wherein said at least one further enzymatic step comprises the enzymatic conversion of undecanedioyl-[acp] methyl ester to monomethyl undecanedioate or undecanedioyl-CoA methyl ester to monomethyl undecanedioate.
15. The method of embodiment 9, wherein said at least one further enzymatic step comprises the enzymatic conversion of tridecanedioyl-[acp] methyl ester to monomethyl tridecanedioate or tridecanedioyl-CoA methyl ester to monomethyl tridecanedioate.

16. The method of embodiment 9, wherein said at least one further enzymatic step comprises the enzymatic conversion of pentadecanedioyl-[acp] methyl ester to monomethyl pentadecanedioate or pentadecanedioyl-CoA methyl ester to monomethyl pentadecanedioate.

17. The method of embodiment 9, wherein said at least one further enzymatic step comprises the enzymatic conversion of heptadecanedioyl-[acp] methyl ester to monomethyl heptadecanedioate or heptadecanedioyl-CoA methyl ester to monomethyl heptadecanedioate.

18. The method of embodiment 9, wherein said at least one further enzymatic step comprises the enzymatic conversion of nonadecanedioyl-[acp] methyl ester to monomethyl nonadecanedioate or nonadecanedioyl-CoA methyl ester to monomethyl nonadecanedioate.

19. The method of any of embodiments 11 to 18, wherein a polypeptide having the activity of a thioesterase enzymatically forms said monomethyl pentanedioate, monomethyl heptanedioate, monomethyl nonanedioate, monomethyl undecanedioate, monomethyl tridecanedioate, monomethyl pentadecanedioate, monomethyl heptadecanedioate, or monomethyl nonadecanedioate; and either holo-ACP or holo-CoA.

20. The method of embodiment 19, wherein said polypeptide having the activity of a thioesterase has at least 50%, at least 60%, at least 70%, or at least 85% sequence homology to the amino acid sequence of any one of SEQ ID NOs: 58-113 or SEQ ID NOs: 182-195.

21. The method of embodiment 9, wherein said at least one further enzymatic step further comprises the enzymatic conversion of said monomethyl carboxylate to a monomethyl carboxylate semialdehyde.

22. The method of embodiment 21, wherein said at least one further enzymatic step comprises the enzymatic conversion of monomethyl pentanedioate to methyl 5-oxopentanoate.

23. The method of embodiment 21, wherein said at least one further enzymatic step comprises the enzymatic conversion of monomethyl heptanedioate to methyl 7-oxoheptanoate.

24. The method of embodiment 21, wherein said at least one further enzymatic step comprises the enzymatic conversion of monomethyl nonanedioate to methyl 9-oxononanoate.

25. The method of embodiment 21, wherein said at least one further enzymatic step comprises the enzymatic conversion of monomethyl undecanedioate to methyl 11-oxoundecanoate.

26. The method of embodiment 21, wherein said at least one further enzymatic step comprises the enzymatic conversion of monomethyl tridecanedioate comprises methyl 13-oxotridecanoate.

27. The method of embodiment 21, wherein said at least one further enzymatic step comprises the enzymatic conversion of monomethyl pentadecanedioate comprises methyl 15-oxopentadecanoate.

28. The method of embodiment 21, wherein said at least one further enzymatic step comprises the enzymatic conversion of monomethyl heptadecanedioate to methyl 17-oxoheptadecanoate.

29. The method of embodiment 21, wherein said at least one further enzymatic step comprises the enzymatic conversion of monomethyl nonadecanedioate to methyl 19-oxononadecanoate.

30. The method of embodiment 21, wherein a polypeptide having the activity of a carboxylate reductase enzymatically forms said monomethyl carboxylate semialdehyde.

31. The method of embodiment 30, wherein said polypeptide having the activity of a carboxylate reductase has at least 50%, at least 60%, at least 70%, or at least 85% sequence homology to the amino acid sequence of any one of SEQ ID NOs: 25-39 or SEQ ID NOs: 196-215.

32. The method of embodiment 21, wherein said at least one further enzymatic step further comprises the enzymatic conversion of said monomethyl carboxylate semialdehyde to a monomethyl aminocarboxylate.

33. The method of embodiment 32, wherein said at least one further enzymatic step comprises the enzymatic conversion of methyl 5-oxopentanoate to monomethyl 5-aminopentanoate.

34. The method of embodiment 32, wherein said at least one further enzymatic step comprises the enzymatic conversion of methyl 7-oxoheptanoate to monomethyl 7-aminoheptanoate.

35. The method of embodiment 32, wherein said at least one further enzymatic step comprises the enzymatic conversion of methyl 9-oxononanoate to monomethyl 9-aminononanoate.

36. The method of embodiment 32, wherein said at least one further enzymatic step comprises the enzymatic conversion of methyl 11-oxoundecanoate to monomethyl 11-aminoundecanoate.

37. The method of embodiment 32, wherein said at least one further enzymatic step comprises the enzymatic conversion of methyl 13-oxotridecanoate to monomethyl 13-aminotridecanoate.

38. The method of embodiment 32, wherein said at least one further enzymatic step comprises the enzymatic conversion of methyl 15-oxopentadecanoate to monomethyl 15-aminopentadecanoate.

39. The method of embodiment 32, wherein said at least one further enzymatic step comprises the enzymatic conversion of methyl 17-oxoheptadecanoate to monomethyl 17-aminoheptadecanoate.

40. The method of embodiment 32, wherein said at least one further enzymatic step comprises the enzymatic conversion of methyl 19-oxononadecanoate to monomethyl 19-aminononadecanoate.

41. The method of embodiment 32, wherein a polypeptide having the activity of an aminotransferase enzymatically forms said monomethyl aminocarboxylate.

42. The method of embodiment 41, wherein said polypeptide having the activity of an aminotransferase has at least 50%, at least 60%, at least 70%, or at least 85% sequence homology to the amino acid sequence of any one of SEQ ID NOs: 116-138 or SEQ ID NOs: 167-181.

43. The method of any one of embodiments 1 to 6, wherein said at least one further enzymatic step comprises the enzymatic conversion of said aliphatic carbon chain backbone to a monomethyl carboxylate semialdehyde.

44. The method of embodiment 43, wherein said at least one further enzymatic step also produces holo-ACP or holo-CoA.

45. The method of embodiment 43, wherein said at least one further enzymatic step comprises the enzymatic conversion of pentanedioyl-[acp] methyl ester to methyl 5-oxopentanoate or pentanedioyl-CoA methyl ester to methyl 5-oxopentanoate.

46. The method of embodiment 43, wherein said at least one further enzymatic step comprises the enzymatic conversion of heptanedioyl-[acp] methyl ester to methyl 7-oxoheptanoate or heptanedioyl-CoA methyl ester to methyl 7-oxoheptanoate.

47. The method of embodiment 43, wherein said at least one further enzymatic step comprises the enzymatic conversion of nonanedioyl-[acp] methyl ester to methyl 9-oxononanoate or nonanedioyl-CoA methyl ester to methyl 9-oxononanoate.

48. The method of embodiment 43, wherein said at least one further enzymatic step comprises the enzymatic conversion of undecanedioyl-[acp] methyl ester to methyl 11-oxoundecanoate or undecanedioyl-CoA methyl ester to methyl 11-oxoundecanoate.

49. The method of embodiment 43, wherein said at least one further enzymatic step comprises the enzymatic conversion of tridecanedioyl-[acp] methyl ester to methyl 13-oxotridecanoate or tridecanedioyl-CoA methyl ester to methyl 13-oxotridecanoate.

50. The method of embodiment 43, wherein said at least one further enzymatic step comprises the enzymatic conversion of pentadecanedioyl-[acp] methyl ester to methyl 15-oxopentadecanoate or pentadecanedioyl-CoA methyl ester to methyl 15-oxopentadecanoate.

51. The method of embodiment 43, wherein said at least one further enzymatic step comprises the enzymatic conversion of heptadecanedioyl-[acp] methyl ester to methyl 17-oxoheptadecanoate or heptadecanedioyl-CoA methyl ester to methyl 17-oxoheptadecanoate.

52. The method of embodiment 43, wherein said at least one further enzymatic step comprises the enzymatic conversion of nonadecanedioyl-[acp] methyl ester to methyl 19-oxononadecanoate or nonadecanedioyl-CoA methyl ester to methyl 19-oxononadecanoate.

53. The method of embodiment 44, wherein a polypeptide having the activity of an acetylating aldehyde dehydrogenase enzymatically forms said monomethyl carboxylate semialdehyde and either holo-ACP or holo-CoA.

54. The method of embodiment 53, wherein said polypeptide having the activity of an acetylating aldehyde dehydrogenase has at least 50%, at least 60%, at least 70%, or at least 85% sequence homology to the amino acid sequence of SEQ ID NO: 18 or SEQ ID NO: 19.

55. The method of embodiment 9, wherein a second terminal functional group is formed by the enzymatic conversion of said monomethyl carboxylate to a dicarboxylic acid.

56. The method of embodiment 55, wherein said dicarboxylic acid is pentanedioic acid, heptanedioic acid, nonanedioic acid, undecanedioic acid, tridecanedioic acid, pentadecanedioic acid, heptadecanedioic acid, or nonadecanedioic acid.

57. The method of embodiment 55, wherein a polypeptide having the activity of an esterase enzymatically forms said dicarboxylic acid.

58. The method of embodiment 56, wherein a polypeptide having the activity of an esterase has at least 50%, at least 60%, at least 70%, or at least 85% sequence homology to the amino acid sequence of any one of SEQ ID NO: 50 or SEQ ID NO: 51.

59. The method of embodiment 21 or 43, wherein a second terminal functional group is formed by the enzymatic conversion of said monomethyl carboxylate semialdehyde to a carboxylate semialdehyde.

60. The method of embodiment 59, wherein said carboxylate semialdehyde is 5-oxopentanoate, 7-oxoheptanoate, 9-oxononanoate, 11-oxoundecanoate, 13-oxotridecanoate, 15-oxopentadecanoate, 17-oxoheptadecanoate, or 19-oxononadecanoate.

61. The method of embodiment 59, wherein a polypeptide having the activity of an esterase enzymatically forms said carboxylate semialdehyde.

62. The method of embodiment 60, wherein said polypeptide having the activity of an esterase has at least 70% sequence identity to the amino acid sequence of SEQ ID NO: 50 or SEQ ID NO: 51.

63. The method of embodiment 32, wherein a second terminal group is formed by the enzymatic conversion of said monomethyl aminocarboxylate to an aminocarboxylate.

64. The method of embodiment 63, wherein said aminocarboxylate is 5-aminopentanoate, 7-aminoheptanoate, 9-aminononanoate, 11-aminoundecanoate, 13-aminotridecanoate, 15-aminopentadecanoate, 17-aminoheptadecanoate, or 19-aminononadecanoate.

65. The method of embodiment 63, wherein a polypeptide having the activity of an esterase enzymatically forms said aminocarboxylate.

66. The method of embodiment 65, wherein said polypeptide having the activity of an esterase has at least 50%, at least 60%, at least 70%, or at least 85% sequence homology to the amino acid sequence of SEQ ID NO: 50 or SEQ ID NO: 51.

67. The method of embodiment 59, further comprising enzymatically converting said carboxylate semialdehyde to an aminocarboxylate.

68. The method of embodiment 67, wherein said aminocarboxylate is 5-aminopentanoate, 7-aminoheptanoate, 9-aminononanoate, 11-aminoundecanoate, 13-aminotridecanoate, 15-aminopentadecanoate, 17-aminoheptadecanoate or 19-aminononadecanoate.

69. The method of embodiment 68, wherein an aminotransferase enzymatically forms said aminocarboxylate.

70. The method of embodiment 72, wherein said aminotransferase has at least 50%, at least 60%, at least 70%, or at least 85% sequence homology to the amino acid sequence of any one of SEQ ID NOs: 116-138 or SEQ ID NOs: 167-181.

71. The method of embodiment 59, further comprising enzymatically converting said carboxylate semialdehyde to a hydroxycarboxylate.

72. The method of embodiment 71, wherein said hydroxycarboxylate is 5-hydroxypentanoate, 7-hydroxyheptanoate, 9-hydroxynonanoate, 11-hydroxyundecanoate, 13-hydroxytridecanoate, 15-hydroxypentadecanoate, 17-hydroxyheptadecanoate, or 19-hydroxynonadecanoate.

73. The method of embodiment 71, wherein a polypeptide having the activity of an alcohol dehydrogenase enzymatically forms said hydroxycarboxylate.

74. The method of embodiment 73, wherein said polypeptide having the activity of an alcohol dehydrogenase has at least 50%, at least 60%, at least 70%, or at least 85% sequence homology to the amino acid sequence of any one of SEQ ID NOs: 20-23.

75. The method of embodiment 59, further comprising enzymatically converting said carboxylate semialdehyde to a diamine.

76. The method of embodiment 75, wherein said carboxylate semialdehyde is enzymatically converted to said diamine in one or more steps involving a polypeptide having the activity of a carboxylate reductase and a polypeptide having the activity of an aminotransferase.

77. The method of embodiment 76, wherein said polypeptide having the activity of a carboxylate reductase has at least 50%, at least 60%, at least 70%, or at least 85% sequence homology to the amino acid sequence of any one of SEQ ID NOs: 25-39 or SEQ ID NOs: 196-215 and said polypeptide having the activity of an aminotransferase has at least 70% sequence identity to the amino acid sequence of any one of SEQ ID NOs: 116-138 or SEQ ID NOs: 167-181.

78. The method of embodiment 75, wherein said diamine is pentane-1,5-diamine, heptane-1,7-diamine, nonane-1,9-diamine, undecane-1,11-diamine, tridecane-1,13-diamine, pentadecane-1,15-diamine, heptadecane-1,17-diamine, or nonadecane-1,19-diamine.

79. The method of embodiments 71, further comprising enzymatically converting said hydroxycarboxylate to a diol.

80. The method of embodiment 79, wherein said hydroxycarboxylate is enzymatically converted to said diol in one or more steps involving a polypeptide having the activity of a carboxylate reductase and a polypeptide having the activity of an alcohol dehydrogenase.

81. The method of embodiment 79, wherein said diol is 1,5-pentanediol, 1,7-heptanediol, 1,9-nonanediol, 1,11-undecanediol, 1,13-tridecanediol, 1,15-pentadecanediol, 1,17-heptadecanediol, or 1,19-nonadecanediol.

82. The method of embodiment 80, wherein said polypeptide having the activity of a carboxylate reductase has at least 50%, at least 60%, at least 70%, or at least 85% sequence homology to the amino acid sequence of any one of SEQ ID NOs: 25-39 or SEQ ID NOs: 196-215 and said polypeptide having the activity of an alcohol dehydrogenase has at least 50%, at least 60%, at least 70%, or at least 85% sequence homology to the amino acid sequence of any one of SEQ ID NOs: 20-23.

83. The method of embodiment 1, wherein said two terminal functional groups are the same.

84. The method of embodiment 1, wherein said two terminal functional groups are different.

85. The method of embodiment 84, wherein said difunctional product comprises a terminal amine and a terminal carboxyl group.

86. The method of embodiment 84, wherein said difunctional product comprises a terminal formyl group.

87. The method of embodiment 84, wherein said difunctional product comprises a terminal hydroxyl group and a terminal carboxyl group.

88. The method of embodiment 83, wherein said two terminal functional groups are amine groups.

89. The method of embodiment 83, wherein said two terminal functional groups are hydroxyl groups.

90. The method of embodiment 87 or 89, wherein a polypeptide having the activity of a 6-hydroxyhexanoate dehydrogenase, a polypeptide having the activity of a 5-hydroxypentanoate dehydrogenase, a polypeptide having the activity of a 4-hydroxybutyrate dehydratase, or a polypeptide having the activity of an alcohol dehydrogenase enzymatically forms a hydroxyl group.

91. The method of embodiment 85 or 87, wherein a polypeptide having the activity of a thioesterase, a polypeptide having the activity of an aldehyde dehydrogenase, a polypeptide having the activity of a 7-oxoheptanoate dehydrogenase, a polypeptide having the activity of a 6-oxohexanoate dehydrogenase, a polypeptide having the activity of a glutaconate CoA-transferase, or a polypeptide having the activity of a reversible succinyl-CoA ligase enzymatically forms a terminal carboxyl group.

92. The method of embodiment 91, wherein said polypeptide having the activity of a thioesterase has at least 50%, at least 60%, at least 70%, or at least 85% sequence homology to the amino acid sequence of any one of SEQ ID NOs: 58-113 or SEQ ID NOs: 182-195.

93. The method of embodiment 85 or 88, wherein a polypeptide having the activity of an aminotransferase or a polypeptide having the activity of a deacetylase enzymatically forms an amine group.

94. The method of embodiment 93, wherein said polypeptide having the activity of an aminotransferase has at least 50%, at least 60%, at least 70%, or at least 85% sequence homology to the amino acid sequence of any one of SEQ ID NOs: 116-138 or or SEQ ID NOs: 167-181.

95. The method of any one of embodiments 1-94, wherein said method is performed in said recombinant host by fermentation.

96. The method of embodiment 95, wherein said recombinant host is subjected to a cultivation strategy under aerobic, anaerobic, micro-aerobic, or mixed oxygen/denitrification cultivation conditions.

97. The method of embodiment 95 or 96, wherein said recombinant host is cultured under conditions of nutrient limitation.

98. The method according to any one of embodiments 95-97, wherein said recombinant host is retained using a ceramic hollow fiber membrane to maintain a high cell density during fermentation.

99. The method of any one of embodiments 95-98, wherein the principal carbon source fed to the fermentation derives from biological or non-biological feedstocks.

100. The method of embodiment 99, wherein the biological feedstock is, or derives from, monosaccharides, disaccharides, lignocellulose, hemicellulose, cellulose, lignin, levulinic acid, formic acid, triglycerides, glycerol, fatty acids, agricultural waste, condensed distillers' solubles, or municipal waste.

101. The method of embodiment 99, wherein the non-biological feedstock is, or derives from, natural gas, syngas, $CO_2/H_2$, methanol, ethanol, benzoate, non-volatile residue (NVR), caustic wash waste stream from cyclohexane oxidation processes, or terephthalic acid/isophthalic acid mixture waste streams.

102. The method of embodiment 99 or 100, wherein the biological feedstock is not, or does not derive from, glucose.

103. The method of any one of embodiments 95-102, wherein the host is a prokaryote.

104. The method of embodiment 103, wherein said prokaryote is from a genus selected from *Escherichia*, *Clostridia*, Corynebacteria, *Cupriavidus*, *Pseudomonas*, *Delftia*, *Bacillus*; *Lactobacillus*, *Lactococcus*, and *Rhodococcus*.

105. The method of embodiment 103 or 104, wherein said prokaryote is selected from *Escherichia coli, Clostridium ljungdahlii, Clostridium autoethanogenum, Clostridium kluyveri, Corynebacterium glutamicum, Cupriavidus necator, Cupriavidus metallidurans, Pseudomonas fluorescens, Pseudomonas putida* or *Pseudomonas oleavorans,* Delftia *acidovorans, Bacillus subtillis, Lactobacillus delbrueckii, Lactococcus lactis,* and *Rhodococcus equi.*

106. The method of any one of embodiments 103-105, wherein said prokaryote is not *Escherichia coli.*

107. The method of any one of embodiments 95-102, wherein the host is a eukaryote.

108. The method of embodiment 107, wherein said eukaryote is from a genus selected from: *Aspergillus; Saccharomyces; Pichia; Yarrowia; Issatchenkia; Debaryomyces; Arxula;* and *Kluyveromyces.*

109. The method of embodiment 107 or 108, wherein said eukaryote is selected from *Aspergillus niger, Saccharomyces cerevisiae, Yarrowia lipolytica, Issathenkia orientalis, Debaryomyces hansenii, Arxula adenoinivorans,* and *Kluyveromyces lactis.*

110. The method of any one of embodiments 95-109, wherein said recombinant host's tolerance to high concentrations of a difunctional product is improved through continuous cultivation in a selective environment.

111. The method of any one of embodiments 95-110, wherein said one or more of the following enzymes is attenuated in said recombinant host: a polyhydroxyalkanoate synthase, an acetyl-CoA thioesterase, an acetyl-CoA specific β-ketothiolase, a phosphotransacetylase forming acetate, an acetate kinase, a lactate dehydrogenase, a menaquinol-fumarate oxidoreductase, a 2-oxoacid decarboxylase producing isobutanol, an alcohol dehydrogenase forming ethanol, a triose phosphate isomerase, a pyruvate decarboxylase, a glucose-6-phosphate isomerase, a transhydrogenase dissipating the NADH or NADPH imbalance, an glutamate dehydrogenase dissipating the NADH or NADPH imbalance, a NADH/NADPH-utilizing glutamate dehydrogenase, a pimeloyl-CoA dehydrogenase; an acyl-CoA dehydrogenase accepting $C_5$, $C_7$, $C_9$, $C_{11}$, $C_{13}$, $C_{15}$, $C_{17}$, or $C_{19}$ building blocks and central precursors as substrates; a glutaryl-CoA dehydrogenase; or apimeloyl-CoA synthetase.

112. The method of any one of embodiments 95-111, wherein said host overexpresses one or more genes encoding: an acetyl-CoA synthetase; a 6-phosphogluconate dehydrogenase; a transketolase; a puridine nucleotide transhydrogenase; a formate dehydrogenase; a glyceraldehyde-3P-dehydrogenase; a malic enzyme; a glucose-6-phosphate dehydrogenase; a fructose 1,6 diphosphatase; a L-alanine dehydrogenase; a L-glutamate dehydrogenase specific to the NADH or NADPH used to generate a co-factor imbalance; a methanol dehydrogenase; a formaldehyde dehydrogenase; a diamine transporter; a dicarboxylate transporter; an S-adenosylmethionine synthetase; or a multidrug transporter.

113. A recombinant host comprising at least one exogenous nucleic acid encoding one or more of: (i) a S-adenosyl-L-methionine (SAM)-dependent methyltransferase, (ii) a polypeptide having the activity of a β-ketoacyl-[acp] synthase or a 6-ketothiolase, (iii) a polypeptide having the activity of a 3-oxoacyl-[acp] reductase, an acetoacetyl-CoA reductase, a 3-hydroxyacyl-CoA dehydrogenase, or a 3-hydroxybutyryl-CoA dehydrogenase, (iv) an enoyl-CoA hydratase or a 3-hydroxyacyl-[acp] dehydratase, and (v) an enoyl-[acp] reductase or a trans-2-enoyl-CoA reductase, said host producing a difunctional product having an odd number of carbon atoms.

114. The recombinant host of embodiment 113, said host comprising a deletion in metJ.

115. The recombinant host of embodiment 113 or 114, wherein said host does not express MetJ.

116. The recombinant host of embodiment 113, wherein said host comprises a deletion in bioH.

117. The recombinant host of embodiment 113 or 116, wherein said host does not express BioH.

118. The recombinant host of any one of embodiments 113-117, said host further comprising at least one exogenous nucleic acid encoding one or more of a thioesterase, an aldehyde dehydrogenase, a 7-oxoheptanoate dehydrogenase, a 6-oxohexanoate dehydrogenase, a glutaconate CoA-transferase, a reversible succinyl-CoA ligase, an acetylating aldehyde dehydrogenase, or a carboxylate reductase, said host producing a dicarboxylic acid having an odd number of carbon atoms.

119. The recombinant host of embodiment 118, wherein said dicarboxylic acid having an odd number of carbon atoms is pentanedioic acid, heptanedioic acid, nonanedioic acid, undecanedioic acid, tridecanedioic acid, pentadecanedioic acid, heptadecanedioic acid, or nonadecanedioic acid.

120. The recombinant host of any one of embodiments 113-117, said host further comprising at least one exogenous nucleic acid encoding an aminotransferase, said host producing an aminocarboxylate having an odd number of carbon atoms.

121. The recombinant host of embodiment 120, wherein said aminocarboxylate having an odd number of carbon atoms is 5-aminopentanoate, 7-aminoheptanoate, 9-aminononanoate, 11-aminoundecanoate, 13-aminotridecanoate, 15-aminopentadecanoate, 17-aminoheptadecanoate, or 19-aminononadecanoate.

122. The recombinant host of any one of embodiments 113-117, said host further comprising at least one exogenous nucleic acid encoding one or more of a 4-hydroxybutyrate dehydrogenase, a 5-hydroxypentanoate dehydrogenase or a 6-hydroxyhexanoate dehydrogenase, said host producing a hydroxycarboxylate having an odd number of carbon atoms.

123. The recombinant host of embodiment 122, wherein said hydroxycarboxylate having an odd number of carbon atoms is 5-hydroxypentanoate, 7-hydroxyheptanoate, 9-hydroxynonanoate, 11-hydroxyundecanoate, 13-hydroxytridecanoate, 15-hydroxypentadecanoate, 17-hydroxyheptadecanoate, or 19-hydroxynonadecanoate.

124. The recombinant host of any one of embodiments 113-123, said host further comprising at least one exogenous nucleic acid encoding one or more of an aminotransferase, a deacetylase, an N-acetyl transferase, or an alcohol dehydrogenase, said host producing a diamine having an odd number of carbon atoms.

125. The recombinant host of embodiment 124, wherein said diamine having an odd number of carbon atoms is pentane-1,5-diamine, heptane-1,7-diamine, nonane-1,9-diamine, undecane-1,11-diamine, tridecane-1,13-diamine, pentadecane-1,15-diamine, heptadecane-1,17-diamine, or nonadecane-1,19-diamine.

126. The recombinant host of embodiment 122, said host further comprising at least one exogenous nucleic acid encoding one or more of a (i) carboxylate reductase enhanced by a phosphopantetheinyl transferase or (ii) an alcohol dehydrogenase, said host producing a diol having an odd number of carbon atoms.

127. The recombinant host of embodiment 126, wherein said diol having an odd number of carbon atoms is 1,5-pentanediol, 1,7-heptanediol, 1,9-nonanediol, 1,11-undecanediol, 1,13-tridecanediol, 1,15-pentadecanediol, 1,17-heptadecanediol, or 1,19-nonadecanediol.

128. A non-naturally occurring organism comprising at least one exogenous nucleic acid encoding at least one polypeptide having the activity of at least one enzyme depicted in any one of FIGS. 1-8.

129. A nucleic acid construct or expression vector comprising at least one polynucleotide encoding one or more polypeptides having an enzymatic activity, wherein the at least one polynucleotide is operably linked to one or more heterologous control sequences that direct production of the one or more polypeptides, wherein the one or more polypeptides is selected from: (a) a polypeptide having the activity of a 3-hydroxyacyl-[acp] dehydratase having at least 50%, at least 60%, at least 70%, or at least 85% sequence homology to the amino acid sequence of SEQ ID NO: 1; (b) a polypeptide having the activity of a 3-hydroxyacyl-CoA dehydrogenase having at least 50%, at least 60%, at least 70%, or at least 85% sequence homology to the amino acid sequence of any one of SEQ ID NOs: 2-4; (c) a polypeptide having the activity of a 3-oxoacyl-[acp] reductase having at least 50%, at least 60%, at least 70%, or at least 85% sequence homology to the amino acid sequence of SEQ ID NO: 5; (d) a polypeptide having the activity of a 4-hydroxybutyrate dehydrogenase having at least 50%, at least 60%, at least 70%, or at least 85% sequence homology to the amino acid sequence of SEQ ID NO: 23; (e) a polypeptide having the activity of a 5-hydroxypentanoate dehydrogenase having at least 50%, at least 60%, at least 70%, or at least 85% sequence homology to the amino acid sequence of SEQ ID NO: 21; (f) a polypeptide having the activity of a 6-hydroxyhexanoate dehydrogenase having at least 50%, at least 60%, at least 70%, or at least 85% sequence homology to the amino acid sequence of SEQ ID NO: 8; (g) a polypeptide having the activity of a 6-oxohexanoate dehydrogenase having at least 50%, at least 60%, at least 70%, or at least 85% sequence homology to the amino acid sequence of SEQ ID NO: 9 or SEQ ID NO: 10; (h) a polypeptide having the activity of a 7-oxoheptanoate dehydrogenase having at least 50%, at least 60%, at least 70%, or at least 85% sequence homology to the amino acid sequence of any one of SEQ ID NOs: 11-13; (i) a polypeptide having the activity of a β-ketoacyl-[acp] synthase having at least 50%, at least 60%, at least 70%, or at least 85% sequence homology to the amino acid sequence of SEQ ID NOs: 14-16; (j) a polypeptide having the activity of a β-ketothiolase having at least 50%, at least 60%, at least 70%, or at least 85% sequence homology to the amino acid sequence of SEQ ID NO: 17; (k) a polypeptide having the activity of an acetylating aldehyde dehydrogenase having at least 50%, at least 60%, at least 70%, or at least 85% sequence homology to the amino acid sequence of SEQ ID NO: 18 or SEQ ID NO: 19; (l) a polypeptide having the activity of an alcohol dehydrogenase having at least 50%, at least 60%, at least 70%, or at least 85% sequence homology to the amino acid sequence of any one of SEQ ID NOs: 20-23; (m) a polypeptide having the activity of an aldehyde dehydrogenase having at least 50%, at least 60%, at least 70%, or at least 85% sequence homology to the amino acid sequence of SEQ ID NO: 24; (n) a polypeptide having the activity of a carboxylate reductase having at least 50%, at least 60%, at least 70%, or at least 85% sequence homology to the amino acid sequence of any one of SEQ ID NOs: 25-39 or SEQ ID NOs: 196-215; (o) a polypeptide having the activity of a CoA-transferase having at least 50%, at least 60%, at least 70%, or at least 85% sequence homology to the amino acid sequence of SEQ ID NO: 40 or SEQ ID NO: 41; (p) a polypeptide having the activity of a deacetylase having at least 50%, at least 60%, at least 70%, or at least 85% sequence homology to the amino acid sequence of any one of SEQ ID NOs: 42-45; (q) a polypeptide having the activity of an enoyl-[acp] reductase having at least 50%, at least 60%, at least 70%, or at least 85% sequence homology to the amino acid sequence of SEQ ID NO: 46 or SEQ ID NO: 6; (r) a polypeptide having the activity of an enoyl-CoA hydratase having at least 50%, at least 60%, at least 70%, or at least 85% sequence homology to the amino acid sequence of any one of SEQ ID NOs: 47-49; (s) a polypeptide having the activity of an esterase having at least 50%, at least 60%, at least 70%, or at least 85% sequence homology to the amino acid sequence of SEQ ID NO: 50 or SEQ ID NO: 51; (t) a polypeptide having the activity of a S-adenosyl-L-methionine (SAM)-dependent methyltransferase having at least 50%, at least 60%, at least 70%, or at least 85% sequence homology to the amino acid sequence of SEQ ID NO: 52; (u) a polypeptide having the activity of a N-acetyltransferase having at least 50%, at least 60%, at least 70%, or at least 85% sequence homology to the amino acid sequence of SEQ ID NO: 53; (v) a polypeptide having the activity of aphosphopantetheine transferase having at least 50%, at least 60%, at least 70%, or at least 85% sequence homology to the amino acid sequence of any one of SEQ ID NOs: 54-57; (w) a polypeptide having the activity of a thioesterase having at least 50%, at least 60%, at least 70%, or at least 85% sequence homology to the amino acid sequence of any one of SEQ ID NOs: 58-113 or SEQ ID NOs: 182-195; (x) a polypeptide having the activity of a trans-2-enoyl-CoA reductase having at least 50%, at least 60%, at least 70%, or at least 85% sequence homology to the amino acid sequence of SEQ ID NO: 114 or SEQ ID NO: 115; and (y) a polypeptide having the activity of an aminotransferase having at least 50%, at least 60%, at least 70%, or at least 85% sequence homology to the amino acid sequence of any one of SEQ ID NOs: 116-138 or SEQ ID NOs: 167-181.

130. A composition comprising the nucleic acid construct or expression vector of embodiment 129.

131. A bio-derived, bio-based or fermentation-derived product, wherein said product comprises:
  i. a composition comprising at least one bio-derived, bio-based, or fermentation-derived compound produced or biosynthesized according to any one of embodiments 1-113, or any combination thereof,
  ii. a bio-derived, bio-based, or fermentation-derived polymer comprising the bio-derived, bio-based, or fermentation-derived composition or compound of i., or any combination thereof,
  iii. a bio-derived, bio-based, or fermentation-derived resin comprising the bio-derived, bio-based, or fermentation-derived compound or bio-derived, bio-based, or fermentation-derived composition of i. or any combination thereof or the bio-derived, bio-based, or fermentation-derived polymer of ii. or any combination thereof,
  iv. a molded substance obtained by molding the bio-derived, bio-based, or fermentation-derived polymer of ii. or the bio-derived, bio-based, or fermentation-derived resin of iii., or any combination thereof,
  v. a bio-derived, bio-based, or fermentation-derived formulation comprising the bio-derived, bio-based, or fermentation-derived composition of i., bio-derived, bio-based, or fermentation-derived compound of i., bio-derived, bio-based, or fermentation-derived polymer of ii., bio-derived, bio-based, or fermentation-derived resin of iii., or bio-derived, bio-based, or fermentation-derived molded substance of iv, or any combination thereof, or
  vi. a bio-derived, bio-based, or fermentation-derived semi-solid or a non-semi-solid stream, comprising the bio-derived, bio-based, or fermentation-derived composition of i., bio-derived, bio-based, or fermentation-derived compound of i., bio-derived, bio-based, or fermentation-derived polymer of ii., bio-derived, bio-based, or fermentation-derived resin of iii., bio-derived, bio-based or fermentation-derived formulation of v., or bio-derived, bio-based, or fermentation-derived molded substance of iv., or any combination thereof.

132. The method of any one of embodiments 1-112, wherein the product is in the form of a salt or derivative thereof.

DESCRIPTION OF THE DRAWINGS

FIG. 21 illustrates the structures of acetamidocarboxylates produced from aliphatic backbones having an odd number of carbon atoms following n cycles of methyl ester shielded carbon chain elongation, where n is 1, 2, 3, 4, 5, 6, 7, or 8.

FIG. 27 illustrates the structures of 3-oxo-carboxyl-ACP methyl esters produced during the $m^{th}$ cycle of methyl shielded carbon chain elongation, where m is 1, 2, 3, 4, 5, 6, 7, or 8.

FIG. 54 illustrates the genetically modified *Escherichia coli* (K12) strains used in Example 11.

FIG. 55 illustrates the assay conditions and comments for using genetically modified *Escherichia coli* (K12) strains for heptanedioic acid production in shake flask experiments.

FIG. 56 illustrates the assay conditions and comments for using genetically modified *Escherichia coli* (K12) strains for heptanedioic acid production in shake flask experiments. Compared to FIG. 55, methionine was added in this assay repeat.

FIG. 58 illustrates the HPLC method used to determine the SAM/SAH levels.

DETAILED DESCRIPTION

Figure 1:
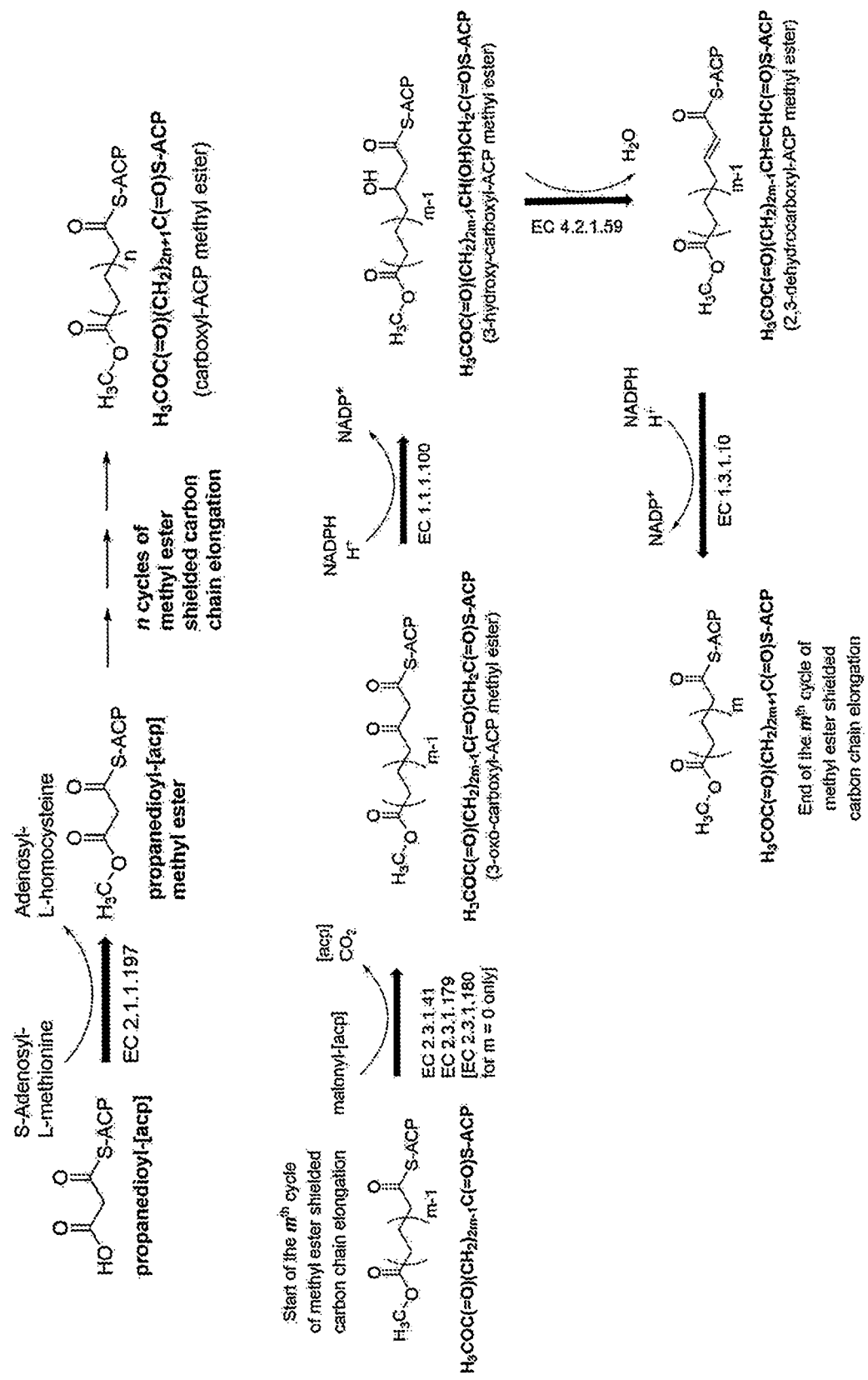
FIG. 1 provides a schematic of an example biochemical pathway leading to a carboxyl-[acp] methyl ester having an odd number of carbon atoms using polypeptides having the activity of one or more NADPH-dependent enzymes and propanedioyl-[acp] as central metabolite following n cycles of methyl ester shielded carbon chain elongation.

This document provides enzymes, non-natural pathways, cultivation strategies, feedstocks, host microorganisms, and attenuations to the host's biochemical network, which generate an aliphatic carbon chain backbone having an odd number of carbon atoms from central metabolites in which two terminal functional groups may be formed leading to the synthesis of difunctional products having an odd number of carbon atoms, such as, for example, dicarboxylic acids, carboxylate semialdehydes, aminocarboxylates, hydroxycarboxylates, diamines, and diols. In some embodiments, the difunctional products have five, seven, nine, eleven, thirteen, fifteen, seventeen, or nineteen carbon atoms (i.e., $C_5$-$C_{19}$ building blocks).

As used herein, a "bio-based product" is a product in which both the feedstock (e.g., sugars from sugar cane, corn, wood; biomass; waste streams from agricultural processes) and the conversion process to the product are biologically based (e.g., fermentation/enzymatic transformation involving a biological host/organism/enzyme). As used herein, a "bio-derived product" is a product in which one of the feedstocks (e.g., sugars from sugar cane, corn, wood; biomass; waste streams from agricultural processes) or the conversion process to the product is biologically based (e.g., fermentation/enzymatic transformation involving a biological host/organism/enzyme).

As used herein, a "fermentation-derived product" is a product produced by fermentation involving a biological host or organism.

As used herein, the term "$C_{2n+3}$ building block" denotes a carbon chain aliphatic backbone having (2n+3) carbon atoms and two terminal functional groups, wherein n is an integer greater than or equal to one, such as a carboxyl-[acp] methyl ester or a carboxyl-CoA methyl ester. For example, as used herein, the term "$C_5$ building block" denotes a difunctional product having a five (5) carbon chain aliphatic backbone. For example, as used herein, the term "$C_7$ building block" denotes a difunctional product having a seven (7) carbon chain aliphatic backbone. For example, as used herein, the term "$C_9$ building block" denotes a difunctional product having a nine (9) carbon chain aliphatic backbone. For example, as used herein, the term "$C_{11}$ building block" denotes a difunctional product having an eleven (11) carbon chain aliphatic backbone. For example, as used herein, the term "$C_{13}$ building block" denotes a difunctional product having a thirteen (13) carbon chain aliphatic backbone. For example, as used herein, the term "$C_{15}$ building block" denotes a difunctional product having a fifteen (15) carbon chain aliphatic backbone. For example, as used herein, the term "$C_{17}$ building block" denotes a difunctional product having a seventeen (17) carbon chain aliphatic backbone. For example, as used herein, the term "$C_{19}$ building block" denotes a difunctional product having a nineteen (19) carbon chain aliphatic backbone.

As used herein, the term "$C_5$-$C_{19}$ building block" means a building block selected from a $C_5$ building block, a $C_7$ building block, a $C_9$ building block, a $C_{11}$ building block, a $C_{13}$ building block, a $C_{15}$ building block, a $C_{17}$ building block, or a $C_{19}$ building block.

As used herein, the term "central precursor" is used to denote any metabolite in any metabolic pathway shown herein leading to the synthesis of a difunctional product having an odd number of carbon atoms, e.g., a $C_5$-$C_{19}$ building block. In some embodiments, a $C_5$-$C_{19}$ building block may serve as a central precursor for the synthesis of another $C_5$-$C_{19}$ building block.

The term "central metabolite" is used herein to denote a metabolite that is produced in all microorganisms to support growth.

Host microorganisms described herein can include endogenous pathways that can be manipulated such that one or more difunctional products having an odd number of carbon atoms (e.g., a $C_5$-$C_{19}$ building block) can be produced. In an endogenous pathway, the host microorganism naturally expresses all of the enzymes catalyzing the reactions within the pathway. A host microorganism containing an engineered pathway does not naturally express all of the enzymes catalyzing the reactions within the pathway but has been engineered such that all of the enzymes within the pathway are expressed in the host.

The term "exogenous" as used herein with reference to a nucleic acid (or a protein) and a host refers to a nucleic acid that does not occur in (and cannot be obtained from) a cell of that particular type as it is found in nature or a protein encoded by such a nucleic acid. Thus, a non-naturally-occurring nucleic acid is considered to be exogenous to a host once in the host. It is important to note that non-naturally-occurring nucleic acids can contain nucleic acid subsequences or fragments of nucleic acid sequences that are found in nature provided the nucleic acid as a whole does not exist in nature. For example, a nucleic acid molecule containing a genomic DNA sequence within an expression vector is non-naturally-occurring nucleic acid, and thus is exogenous to a host cell once introduced into the host, since that nucleic acid molecule as a whole (genomic DNA plus vector DNA) does not exist in nature. Thus, any vector, autonomously replicating plasmid, or virus (e.g., retrovirus, adenovirus, or herpes virus) that as a whole does not exist in nature is considered to be non-naturally-occurring nucleic acid. It follows that genomic DNA fragments produced by PCR or restriction endonuclease treatment as well as cDNAs are considered to be non-naturally-occurring nucleic acids since they exist as separate molecules not found in nature. It also follows that any nucleic acid containing a promoter sequence and polypeptide-encoding sequence (e.g., cDNA or genomic DNA) in an arrangement not found in nature is a non-naturally-occurring nucleic acid. A nucleic acid that is naturally-occurring can be exogenous to a particular host microorganism. For example, an entire chromosome isolated from a cell of yeast x is an exogenous nucleic acid with respect to a cell of yeast y once that chromosome is introduced into a cell of yeast y.

In contrast, the term "endogenous" as used herein with reference to a nucleic acid (e.g., a gene) (or a protein) and a host refers to a nucleic acid (or protein) that does occur in (and can be obtained from) that particular host as it is found in nature. Moreover, a cell "endogenously expressing" a nucleic acid (or protein) expresses that nucleic acid (or protein) as does a host of the same particular type as it is found in nature. Moreover, a host "endogenously producing" or that "endogenously produces" a nucleic acid, protein, or other compound produces that nucleic acid, protein, or compound as does a host of the same particular type as it is found in nature.

For example, depending on the host and the compounds produced by the host, one or more polypeptides having the activity of one or more of the following enzymes may be expressed in the host in addition to an S-adenosyl-L-methionine (SAM)-dependent methyltransferase: a β-ketoacyl-[acp] synthase, a β-ketothiolase, a 3-oxoacyl-[acp] reductase, acetoacetyl-CoA reductase, a 3-hydroxyacyl-CoA dehydrogenase, a 3-hydroxybutyryl-CoA dehydrogenase, an enoyl-CoA hydratase, 3-hydroxyacyl-[acp] dehydratase, an enoyl-[acp] reductase, a trans-2-enoyl-CoA reductase, an esterase, a thioesterase, a reversible CoA ligase, a CoA-transferase, an acetylating aldehyde dehydrogenase, a 6-oxohexanoate dehydrogenase, a 7-oxoheptanoate dehydrogenase, an aldehyde dehydrogenase, a carboxylate reductase, an aminotransferase, a N-acetyl transferase, an alcohol dehydrogenase, a deacetylase, a 6-hydroxyhexanoate dehydrogenase, a 5-hydroxypentanoate dehydrogenase, or a 4-hydroxybutyrate dehydrogenase. In recombinant hosts expressing a polypeptide having the activity of a carboxylate reductase, a polypeptide having the activity of phosphopantetheinyl transferase also can be expressed to enhance the activity of the polypeptide having the activity of a carboxylate reductase.

For example, a recombinant host can include at least one exogenous nucleic acid encoding one or more of (i) an S-adenosyl-L-methionine (SAM)-dependent methyltransferase, (ii) a β-ketoacyl-[acp] synthase or a β-ketothiolase, (iii) a 3-oxoacyl-[acp] reductase, acetoacetyl-CoA reductase, a 3-hydroxyacyl-CoA dehydrogenase or a 3-hydroxybutyryl-CoA dehydrogenase, (iv) an enoyl-CoA hydratase or 3-hydroxyacyl-[acp] dehydratase, (v) an enoyl-[acp] reductase or a trans-2-enoyl-CoA reductase and produce a carboxyl-[acp] methyl ester or a carboxyl-CoA methyl ester. In some embodiments, the carboxyl-[acp] methyl ester or carboxyl-CoA methyl ester is: i) pentanedioyl-[acp] methyl ester or pentanedioyl-CoA methyl ester, ii) heptanedioyl-[acp] methyl ester or heptanedioyl-CoA methyl ester, iii) nonanedioyl-[acp] methyl ester or nonanedioyl-CoA methyl ester, iv) undecanedioyl-[acp] methyl ester or undecanedioyl-CoA methyl ester, v) tridecanedioyl-[acp] methyl ester or tridecanedioyl-CoA methyl ester, vi) pentadecanedioyl-[acp] methyl ester or pentadecanedioyl-CoA methyl ester, vii) heptadecanedioyl-[acp] methyl ester or heptadecanedioyl-CoA methyl ester, or viii) nonadecanedioyl-[acp] methyl ester or nonadecanedioyl-CoA methyl ester.

Such recombinant hosts producing a carboxyl-[acp] methyl ester or a carboxyl-CoA methyl ester further can include at least one exogenous nucleic acid encoding one or more of an esterase, a thioesterase, an aldehyde dehydrogenase, a 7-oxoheptanoate dehydrogenase, a 6-oxohexanoate dehydrogenase, a glutaconate CoA-transferase, a reversible succinyl-CoA ligase, an acetylating aldehyde dehydrogenase, or a carboxylate reductase and produce a dicarboxylic acid, monomethyl carboxylate, carboxylate semialdehyde or monomethyl carboxylate semialdehyde. For example, a recombinant host producing a carboxyl-[acp] methyl ester or a carboxyl-CoA methyl ester further can include at least one exogenous nucleic acid encoding one or more of a thioesterase, a reversible CoA-ligase (e.g., a reversible succinyl-CoA ligase), or a CoA transferase (e.g., a glutaconate CoA-transferase) and produce a monomethyl carboxylate. For example, a recombinant host producing a monomethyl carboxylate further can include at least one exogenous nucleic acid encoding an esterase and produce a dicarboxylic acid. For example, a recombinant host producing a carboxyl-CoA methyl ester further can include at least one exogenous nucleic acid encoding an acetylating aldehyde dehydrogenase and produce a monomethyl carboxylate semialdehyde. For example, a recombinant host producing a monomethyl carboxylate semialdehyde further can include at least one exogenous nucleic acid encoding a 7-oxoheptanoate dehydrogenase or an aldehyde dehydrogenase and produce a monomethyl carboxylate. For example, a recombinant host producing a monomethyl carboxylate further can include at least one exogenous nucleic acid encoding an esterase and produce a dicarboxylic acid.

A recombinant host producing a monomethyl carboxylate semialdehyde further can include at least one exogenous nucleic acid encoding an aminotransferase and produce a monomethyl aminocarboxylate. A recombinant host producing a monomethyl aminocarboxylate further can include at least one exogenous nucleic acid encoding an esterase and produce an aminocarboxylate. In some embodiments, a recombinant host producing a carboxyl-CoA methyl ester includes at least one exogenous nucleic acid encoding one or more of an esterase, a carboxylate reductase, and an aminotransferase to produce an aminocarboxylate.

A recombinant host producing a dicarboxylic acid or a carboxylate semialdehyde further can include at least one exogenous nucleic acid encoding one or more of a 6-hydroxyhexanoate dehydrogenase, a 5-hydroxypentanoate dehydrogenase, or a 4-hydroxybutyrate dehydrogenase, and produce a hydroxycarboxylate. In some embodiments, a recombinant host producing a carboxyl-CoA methyl ester includes at least one exogenous nucleic acid encoding one or more of an esterase, an acetylating aldehyde dehydrogenase, a 6-hydroxyhexanoate dehydrogenase, a 5-hydroxypentanoate dehydrogenase, or a 4-hydroxybutyrate dehydrogenase to produce a hydroxycarboxylate. In some embodiments, a recombinant host producing a dicarboxylic acid includes at least one exogenous nucleic acid encoding one or more of a carboxylate reductase, a 6-hydroxyhexanoate dehydrogenase, a 5-hydroxypentanoate dehydrogenase, or a 4-hydroxybutyrate dehydrogenase to produce a hydroxycarboxylate A recombinant host producing an aminocarboxylate, a hydroxycarboxylate, or a carboxylate semialdehyde further can include at least one exogenous nucleic acid encoding one or more of an aminotransferase, a deacetylase, a N-acetyl transferase, or an alcohol dehydrogenase, and produce a diamine. For example, a recombinant host producing a hydroxycarboxylate can include at least one exogenous nucleic acid encoding one or more of a carboxylate reductase with a phosphopantetheine transferase enhancer, an aminotransferase, or an alcohol dehydrogenase.

A recombinant host producing a hydroxycarboxylate further can include at least one exogenous nucleic acid encoding a carboxylate reductase with aphosphopantetheine transferase enhancer and/or an alcohol dehydrogenase, and produce a diol.

A recombinant host producing an aminocarboxylate further can include at least one exogenous nucleic acid encoding a carboxylate reductase with a phosphopantetheine transferase enhancer and/or at least one exogenous nucleic acid encoding an alcohol dehydrogenase, and produce a hydroxyamine.

Any of the recombinant hosts described herein may comprise a deletion in bioH, a pimelyl-[acp] methyl ester esterase classified, for example, under EC 3.1.1.85. In some embodiments, the recombinant host does not express BioH. In some embodiments, the recombinant host may comprise a step of down-regulating a repressor that inhibits the initial step of adding a methyl ester shield to propanedioyl-CoA or propanedioyl-[acp]. S-Adenosyl-methionine (SAM)-dependent methyltransferases (MTases) catalyze the transfer of methyl groups from SAM to propanedioyl-CoA or propanedioyl-[acp]. The metJ gene encodes a regulatory protein which when combined with SAM represses the expression of the methionine regulon and of enzymes involved in SAM synthesis. Accordingly, in some embodiments, the recombinant host may comprise a deletion in metJ, a SAM co-repressor that represses the initial step of adding a methyl ester shield to propanedioyl-CoA or propanedioyl-[acp]. In some embodiments, the recombinant host does not express MetJ.

Enzymes

Within an engineered pathway, the enzymes can be from a single source, i.e., from one genus or species, or can be from multiple sources, i.e., different species. Nucleic acids encoding the enzymes described herein have been identified from various organisms and are readily available in publicly available databases such as GenBank, UniProt, or EMBL. Enzyme Commission (EC) numbers for many enzymes are also provided. EC numbers are well known in the art and provide a numerical classification scheme for enzymes based on the chemical reactions they catalyze. An enzyme classified with an EC number to the fourth level is discretely and specifically classified on the basis of the reactions that its members are able to perform. Well known nomenclature databases such as ENZYME, maintained by the Swiss Institute of Bioinformatics, and BRENDA provide examples of specific enzymes corresponding to specific EC numbers.

Any of the enzymes described herein that can be used for production of one or more difunctional products having an odd number of carbon atoms (i.e., $C_5$-$C_{19}$ building blocks) can have at least 50%, at least 60% or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or at least 100%) to the amino acid sequence of the corresponding wild-type enzyme. It will be appreciated that the sequence identity can be determined on the basis of the mature enzyme (e.g., with any signal sequence removed).

The percent identity and homology between two amino acid sequences can be determined as follows. First, the amino acid sequences are aligned using the BLAST 2 Sequences (Bl2seq) program from the stand-alone version of BLASTZ containing BLASTP version 2.0.14. This stand-alone version of BLASTZ can be obtained the U.S. government's National Center for Biotechnology Information web site. Instructions explaining how to use the Bl2seq program can be found in the readme file accompanying BLASTZ. Bl2seq performs a comparison between two amino acid sequences using the BLASTP algorithm. To compare two amino acid sequences, the options of Bl2seq are set as follows: -i is set to a file containing the first amino acid sequence to be compared (e.g., C:\seq1.txt); -j is set to a file containing the second amino acid sequence to be compared (e.g., C:\seq2.txt); -p is set to blastp; -o is set to any desired file name (e.g., C:\output.txt); and all other options are left at their default setting. For example, the following command can be used to generate an output file containing a comparison between two amino acid sequences: C:\Bl2seq -i c:\seq1.txt -j c:\seq2.txt -p blastp -o c:\output.txt. If the two compared sequences share homology (identity), then the designated output file will present those regions of homology as aligned sequences. If the two compared sequences do not share homology (identity), then the designated output file will not present aligned sequences. Similar procedures can be followed for nucleic acid sequences except that blastn is used.

Second, once aligned, the number of matches is determined by counting the number of positions where an identical amino acid residue is presented in both sequences. The percent identity is determined by dividing the number of matches by the length of the full-length polypeptide amino acid sequence followed by multiplying the resulting value by 100. It is noted that the percent identity value is rounded to the nearest tenth. For example, 78.11, 78.12, 78.13, and 78.14 are rounded down to 78.1, while 78.15, 78.16, 78.17, 78.18, and 78.19 are rounded up to 78.2. It also is noted that the length value will always be an integer.

When percentage of sequence identity is used with reference to proteins, it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. Where sequences differ in conservative substitutions, the percent sequence identity may be adjusted upwards to correct for the conservative nature of the substitution and this process results in "sequence homology" of, e.g., at least 75%, at least 80%, at least 85%, at least 90%, at least 91%, at least 92%, at least 93%, at least 94%, at least 95%, at least 96%, at least 97%, at least 98%, or at least 99%. Means for making this adjustment are well known to those of ordinary skill in the art. Typically, this adjustment involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., according to the algorithm of Meyers and Miller, Computer. Applic. Biol. Sci., 1988, 4, 11-17, e.g., as implemented in the program PC/GENE (Intelligenetics, Mountain View, Cailf., USA). This alignment and the percent homology or identity can be determined using any suitable software program known in the art, for example those described in CURRENT PROTOCOLS IN MOLECULAR BIOLOGY (F. M. Ausubel et al. (eds) 1987, Supplement 30, section 7.7.18). Such programs may include the GCG Pileup program, FASTA (Pearson et al., Proc. Natl. Acad. Sci. USA, 1988, 85, 2444-2448), and BLAST (BLAST Manual, Altschul et al., Nat'l Cent. Biotechnol. Inf., Nat'l Lib. Med. (NCIB NLM NIH), Bethesda, Md., and Altschul et al., NAR, 1997, 25, 3389-3402). Another alignment program is ALIGN Plus (Scientific and Educational Software, Pa.), using default parameters. Another sequence software program that finds use is the TFASTA Data Searching Program available in the Sequence Software Package Version 6.0 (Genetics Computer Group, University of Wisconsin, Madison, Wis.).

A conservative substitution is a substitution of one amino acid for another with similar characteristics. Conservative substitutions include substitutions within the following groups: valine, alanine, and glycine; leucine, valine, and isoleucine; aspartic acid and glutamic acid; asparagine and glutamine; serine, cysteine, and threonine; lysine and arginine; and phenylalanine and tyrosine. The nonpolar hydrophobic amino acids include alanine, leucine, isoleucine, valine, proline, phenylalanine, tryptophan, and methionine. The polar neutral amino acids include glycine, serine, threonine, cysteine, tyrosine, asparagine, and glutamine. The positively charged (basic) amino acids include arginine, lysine, and histidine. The negatively charged (acidic) amino acids include aspartic acid and glutamic acid. Any substitution of one member of the above mentioned polar, basic, or acidic groups by another member of the same group can be deemed a conservative substitution. By contrast, a non-conservative substitution is a substitution of one amino acid for another with dissimilar characteristics.

For example, a polypeptide having the activity of a 3-hydroxyacyl-[acp] dehydratase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 1.

For example, a polypeptide having the activity of a 3-hydroxyacyl-CoA dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 2-4.

For example, a polypeptide having the activity of a 3-oxoacyl-[acp] reductase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 5.

For example, a polypeptide having the activity of a 4-hydroxybutyrate dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 23.

For example, a polypeptide having the activity of a 5-hydroxypentanoate dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 21.

For example, a polypeptide having the activity of a 6-hydroxyhexanoate dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 8.

For example, a polypeptide having the activity of a 6-oxohexanoate dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 9 or SEQ ID NO: 10.

For example, a polypeptide having the activity of a 7-oxoheptanoate dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 11-13.

For example, a polypeptide having the activity of a β-ketoacyl-[acp] synthase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 14-16.

For example, a polypeptide having the activity of a β-ketothiolase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 17.

For example, a polypeptide having the activity of an acetylating aldehyde dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 18 or SEQ ID NO: 19.

For example, a polypeptide having the activity of an alcohol dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 20-23.

For example, a polypeptide having the activity of an aldehyde dehydrogenase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 24.

For example, a polypeptide having the activity of a carboxylate reductase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 25-39 or SEQ ID NOs: 196-215.

For example, a polypeptide having the activity of a CoA-transferase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 40 or SEQ ID NO: 41.

For example, a polypeptide having the activity of a deacetylase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 42-45.

For example, a polypeptide having the activity of an enoyl-[acp] reductase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 46 or SEQ ID NO: 6.

For example, a polypeptide having the activity of an enoyl-CoA hydratase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 47-49.

For example, a polypeptide having the activity of an esterase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 50 or SEQ ID NO: 51.

For example, a polypeptide having the activity of a S-adenosyl-L-methionine (SAM)-dependent methyltransferase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 52.

For example, a polypeptide having the activity of a N-acetyltransferase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 53.

For example, a polypeptide having the activity of a phosphopantetheine transferase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 54-57.

For example, a polypeptide having the activity of a thioesterase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 58-113 or SEQ ID NOs: 182-195. Alternative names for a thioesterase include, but are not limited to, acyl-ACP thioesterase, acyl-CoA thioesterase, arylesterase, lysophospholipase, acyl-[acyl-carrier-protein] hydrolase, acyl-ACP-hydrolase, acyl-acyl carrier protein hydrolase, oleoyl-ACP thioesterase, oleoyl-acyl carrier protein thioesterase, lauryl-acyl-carrier-protein hydrolase, dodecanoyl-acyl-carrier-protein hydrolase, and dodecyl-acyl-carrier protein hydrolase.

For example, a polypeptide having the activity of a trans-2-enoyl-CoA reductase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of SEQ ID NO: 7, SEQ ID NO: 114, or SEQ ID NO: 115.

For example, a polypeptide having the activity of an aminotransferase described herein can have at least 50%, at least 60%, or at least 70% sequence identity or homology (e.g., at least 50%, at least 55%, at least 60%, at least 65%, at least 70%, at least 75%, at least 80%, at least 85%, at least 90%, at least 95%, at least 97%, at least 98%, at least 99%, or 100%) to the amino acid sequence of any one of SEQ ID NOs: 116-138 or SEQ ID NOs: 167-181. Alternative names for an aminotransferase include, but are not limited to, co-transaminase, class III aminotransferase, acetylornithine aminotransferase, ornithine aminotransferase, omega-amino acid-pyruvate aminotransferase, 4-aminobutyrate aminotransferase, DAPA aminotransferase, 2,2-dialkylglycine decarboxylase, taurine-pyruvate aminotransferase, and glutamate-1-semialdehyde aminotransferase.

It will be appreciated that a number of nucleic acids can encode a polypeptide having a particular amino acid sequence. The degeneracy of the genetic code is well known to the art; i.e., for many amino acids, there is more than one nucleotide triplet that serves as the codon for the amino acid. For example, codons in the coding sequence for a given enzyme can be modified such that optimal expression in a particular species (e.g., bacteria or fungus) is obtained, using appropriate codon bias tables for that species.

Functional fragments of any of the enzymes described herein can also be used in the methods of the document. The term "functional fragment" as used herein refers to a peptide fragment of a protein that has at least 25% (e.g., at least 30%; at least 40%; at least 50%; at least 60%; at least 70%; at least 75%; at least 80%; at least 85%; at least 90%; at least 95%; at least 98%; at least 99%; at least 100%; or even greater than 100%) of the activity of the corresponding mature, full-length, wild-type protein. The functional fragment can generally, but not always, be comprised of a continuous region of the protein, wherein the region has functional activity.

This document also provides (i) functional variants of the enzymes used in the methods of the document and (ii) functional variants of the functional fragments described above. Functional variants of the enzymes and functional fragments can contain additions, deletions, or substitutions relative to the corresponding wild-type sequences. Enzymes with substitutions will generally have not more than 50 (e.g., not more than one, not more than two, not more than three, not more than four, not more than five, not more than six, not more than seven, not more than eight, not more than nine, not more than ten, not more than 12, not more than 15, not more than 20, not more than 25, not more than 30, not more than 35, not more than 40, or not more than 50) amino acid substitutions (e.g., conservative substitutions). This applies to any of the enzymes described herein and functional fragments. A conservative substitution is a substitution of one amino acid for another with similar characteristics. Conservative substitutions include substitutions within the following groups: valine, alanine and glycine; leucine, valine, and isoleucine; aspartic acid and glutamic acid; asparagine and glutamine; serine, cysteine, and threonine; lysine and arginine; and phenylalanine and tyrosine. The nonpolar hydrophobic amino acids include alanine, leucine, isoleucine, valine, proline, phenylalanine, tryptophan and methionine. The polar neutral amino acids include glycine, serine, threonine, cysteine, tyrosine, asparagine and glutamine. The positively charged (basic) amino acids include arginine, lysine and histidine. The negatively charged (acidic) amino acids include aspartic acid and glutamic acid. Any substitution of one member of the above-mentioned polar, basic or acidic groups by another member of the same group can be deemed a conservative substitution. By contrast, a nonconservative substitution is a substitution of one amino acid for another with dissimilar characteristics.

Deletion variants can lack one, two, three, four, five, six, seven, eight, nine, ten, 11, 12, 13, 14, 15, 16, 17, 18, 19, or 20 amino acid segments (of two or more amino acids) or non-contiguous single amino acids. Additions (addition variants) include fusion proteins containing: (a) any of the enzymes described herein or a fragment thereof; and (b) internal or terminal (C or N) irrelevant or heterologous amino acid sequences. In the context of such fusion proteins, the term "heterologous amino acid sequences" refers to an amino acid sequence other than (a). A heterologous sequence can be, for example a sequence used for purification of the recombinant protein (e.g., FLAG, polyhistidine (e.g., hexahistidine (SEQ ID NO: 166)), hemagglutinin (HA), glutathione-S-transferase (GST), or maltosebinding protein (MBP)). Heterologous sequences also can be proteins useful as detectable markers, for example, luciferase, green fluorescent protein (GFP), or chloramphenicol acetyl transferase (CAT). In some embodiments, the fusion protein contains a signal sequence from another protein. In certain host cells (e.g., yeast host cells), expression and/or secretion of the target protein can be increased through use of a heterologous signal sequence. In some embodiments, the fusion protein can contain a carrier (e.g., KLH) useful, e.g., in eliciting an immune response for antibody generation) or ER or Golgi apparatus retention signals. Heterologous sequences can be of varying length and in some cases can be longer sequences than the full-length target proteins to which the heterologous sequences are attached.

Engineered hosts can naturally express none or some (e.g., one or more, two or more, three or more, four or more, five or more, or six or more) of the enzymes of the pathways described herein. Thus, a pathway within an engineered host can include all exogenous enzymes, or can include both endogenous and exogenous enzymes. Endogenous genes of the engineered hosts also can be disrupted to prevent the formation of undesirable metabolites or prevent the loss of intermediates in the pathway through other enzymes acting on such intermediates. Engineered hosts can be referred to as recombinant hosts or recombinant host cells. As described herein, recombinant hosts can include nucleic acids encoding one or more of a methyltransferase, a synthase, β-ketothiolase, a dehydratase, a hydratase, a dehydrogenase, an esterase, a thioesterase, a reversible CoA-ligase, a CoA-transferase, a reductase, deacetylase, N-acetyltransferase or an aminotransferase as described in more detail below.

In addition, the production of one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks), can be performed in vitro using the isolated enzymes described herein, using a lysate (e.g., a cell lysate) from a host microorganism as a source of the enzymes, or using a plurality of lysates from different host microorganisms as the source of the enzymes.

Figure 2:
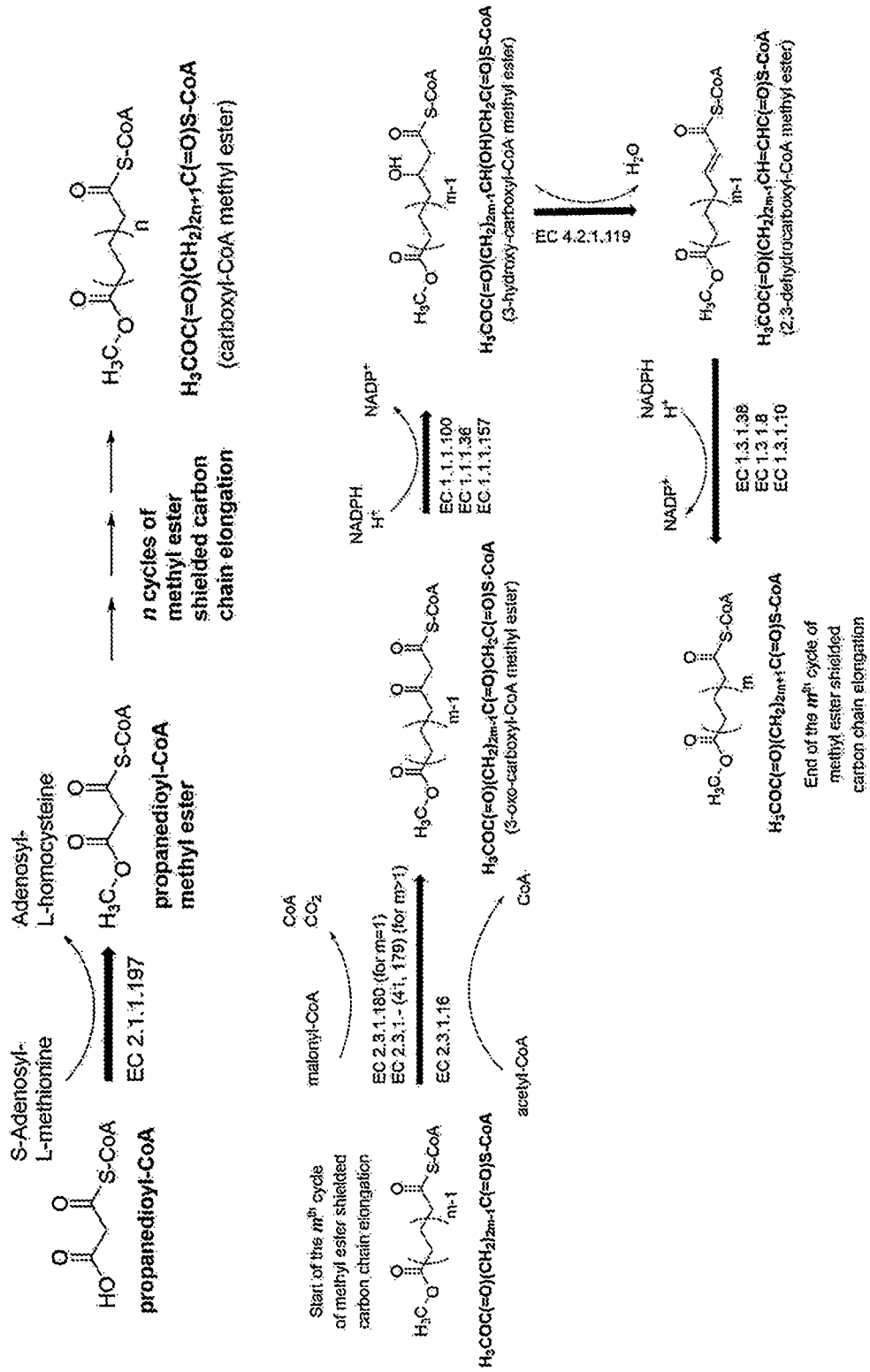
FIG. 2 is a schematic of an example biochemical pathway leading to a carboxyl-CoA methyl ester having an odd number of carbon atoms using polypeptides having the activity of one or more NADPH-dependent enzymes and acetyl-CoA and propanedioyl-CoA as central metabolites.
Figure 3:
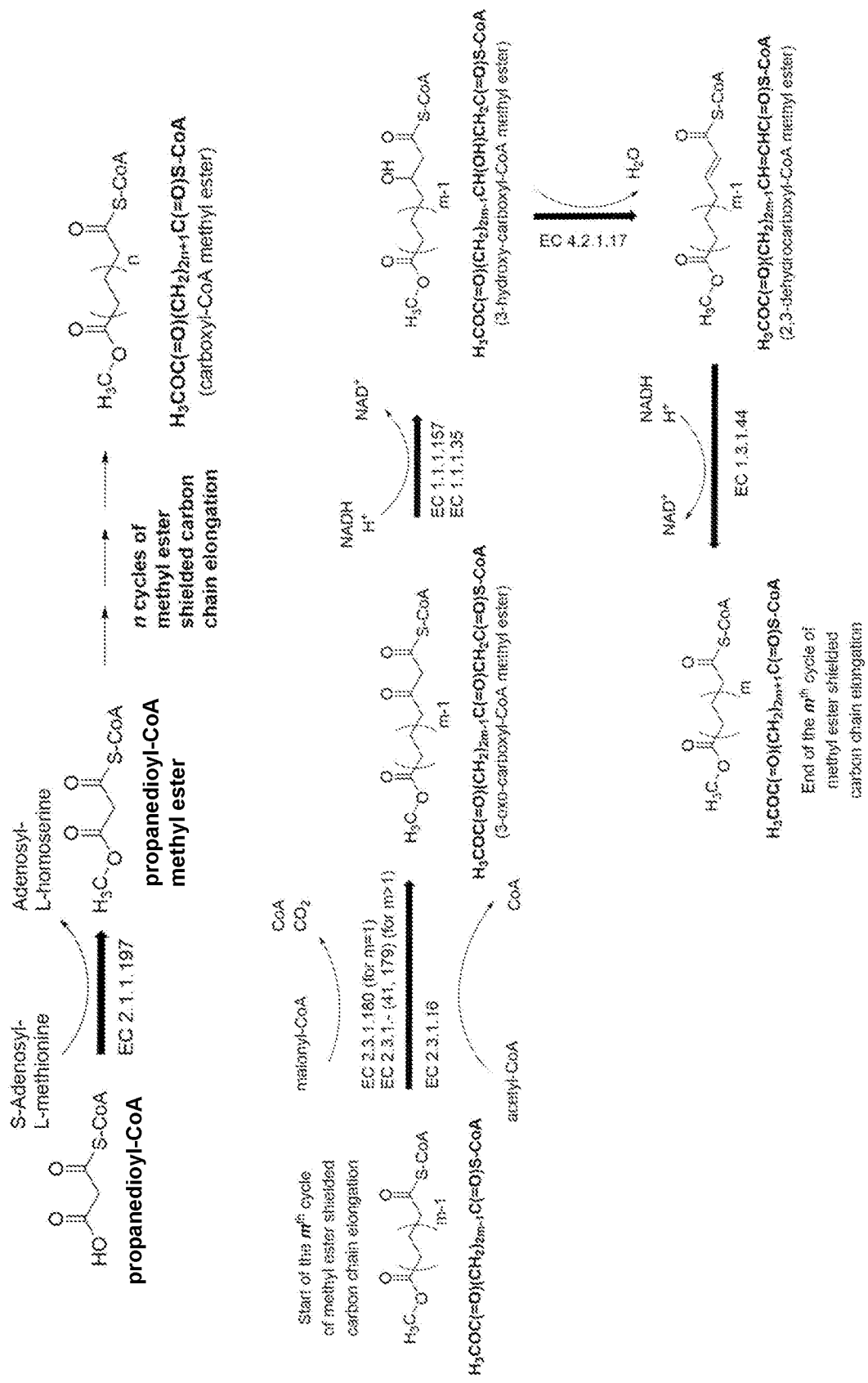
FIG. 3 is a schematic of an example biochemical pathway leading to carboxyl-CoA methyl ester having an odd number of carbon atoms using polypeptides having the activity of one or more NADH-dependent enzymes and acetyl-CoA and propanedioyl-CoA as central metabolites.

Enzymes Generating the $C_{2n+3}$ Aliphatic Backbone for Conversion to $C_{2n+3}$ Building Blocks As depicted in FIGS. 1-3, a $C_{2n+3}$ aliphatic backbone $H_3COC(=O)(CH_2)_{2n+1}C(=O)S\text{-ACP}$ or $H_3COC(=O)(CH_2)_{2n+1}C(=O)S\text{—CoA}$ for conversion to one or more $C_{2n+3}$ building blocks can be formed from propanedioyl-[acp], or acetyl-CoA and propanedioyl-CoA, via n cycles of methyl-ester shielded carbon chain elongation associated with biotin synthesis using polypeptides having the activity of one or more either NADH or NADPH dependent enzymes, wherein n is an integer greater than or equal to one, such as, for example, one, two, three, four, five, six, seven, or eight.

For example, when n is 1, the aliphatic backbone is pentanedioyl-[acp] methyl ester or pentanedioyl-CoA methyl ester. For example, when n is 2, the aliphatic backbone is heptanedioyl-[acp] methyl ester or heptanedioyl-CoA methyl ester. For example, when n is 3, the aliphatic backbone is nonanedioyl-[acp] methyl ester or nonanedioyl-CoA methyl ester. For example, when n is 4, the aliphatic backbone is undecanedioyl-[acp] methyl ester or undecanedioyl-CoA methyl ester. For example, when n is 5, the aliphatic backbone is tridecanedioyl-[acp] methyl ester or tridecanedioyl-CoA methyl ester. For example, when n is 6, the aliphatic backbone is pentadecanedioyl-[acp] methyl ester or pentadecanedioyl-CoA methyl ester. For example, when n is 7, the aliphatic backbone is heptadecanedioyl-[acp] methyl ester or heptadecanedioyl-CoA methyl ester. For example, when n is 8, the aliphatic backbone is nonadecanedioyl-[acp] methyl ester or nonadecanedioyl-CoA methyl ester. See Table 1.

In some embodiments, a methyl ester shielded carbon chain elongation associated with biotin biosynthesis route comprises using a polypeptide having the activity of S-adenosyl-L-methionine (SAM)-dependent methyltransferase to form a propanedioyl-[acp] methyl ester, and then performing n cycles of carbon chain elongation, wherein n is an integer greater than or equal to one, such as, for example, one, two, three, four, five, six, seven, or eight, using one or more polypeptides having the activity of one or more of a β-ketoacyl-[acp] synthase, a 3-oxoacyl-[acp] reductase, a 3-hydroxyacyl-[acp] dehydratase, and an enoyl-[acp] reductase.

In some embodiments, a methyl ester shielded carbon chain elongation route comprises using a polypeptide having the activity of S-adenosyl-L-methionine (SAM)-dependent methyltransferase to form a propanedioyl-CoA methyl ester, and then performing n cycles of carbon chain elongation, wherein n is an integer greater than or equal to one, such as, for example, one, two, three, four, five, six, seven, or eight, using one or more polypeptides having the activity of one or more of (i) a β-ketothiolase or a β-ketoacyl-[acp] synthase, (ii) an acetoacetyl-CoA reductase, a 3-oxoacyl-[acp] reductase, or a 3-hydroxybutyryl-CoA dehydrogenase, (iii) enoyl-CoA hydratase, and (iv) a trans-2-enoyl-CoA reductase.

In some embodiments, a methyltransferase can be an S-adenosyl-L-methionine (SAM)-dependent methyltransferase classified, for example, under EC 2.1.1.197, such as the gene product of bioC. For example, in some embodiments, a polypeptide having the activity of a methyltransferase or S-adenosyl-L-methionine (SAM)-dependent methyltransferase is a *Bacillus cereus* S-adenosyl-L-methionine (SAM)-dependent methyltransferase (see UniProtKB Accession No. Q73I11 (SEQ ID NO: 52)). See, for example, Lin, 2012, Biotin Synthesis in *Escherichia coli*, Ph.D. Dissertation, University of Illinois at Urbana-Champaign).

In some embodiments, a f-ketothiolase may be classified, for example, under EC 2.3.1.-, such as, for example, EC 2.3.1.16, such as the gene product of bktB, such as, for example, a *Cupriavidus necator* β-ketothiolase (see UniProtKB Accession No. Q0KBP1 (SEQ ID NO: 17)). The β-ketothiolase encoded by bktB from *Cupriavidus necator* (SEQ ID NO: 17) can accept propanoyl-CoA and pentanedioyl-CoA as substrates, forming a CoA-activated $C_7$ aliphatic backbone (see, e.g., Haywood et al., *FEMS Microbiology Letters*, 1988, 52:91-96; Slater et al., *J. Bacteriol.*, 1998, 180(8):1979-1987).

In some embodiments, a β-ketoacyl-[acp] synthase may be classified, for example, under EC 2.3.1.- (e.g., EC 2.3.1.41, EC 2.3.1.179, or EC 2.3.1.180), such as the gene product of fabB, fabF, or fabH. In some embodiments, a polypeptide having the activity of a β-ketoacyl-[acp] synthase is classified under EC 2.3.1.41, such as the gene product of fabB, such as a *Xanthomonas axonopodis* pv. *citri* (strain 306) β-ketoacyl-[acp] synthase (see UniProtKB Accession No. Q8PGJ1 (SEQ ID NO: 14)). In some embodiments, a polypeptide having the activity of a β-ketoacyl-[acp] synthase is classified under EC 2.3.1.179, such as the gene product of fabF, such as a *Xanthomonas axonopodis* pv. *citri* (strain 306) β-ketoacyl-[acp] synthase (see UniProtKB Accession No. Q8PNE3 (SEQ ID NO: 15)). In some embodiments, a polypeptide having the activity of a β-ketoacyl-[acp] synthase is classified under EC 2.3.1.180, such as the gene product of fabH, such as a *Xanthomonas axonopodis* pv. *citri* (strain 306) β-ketoacyl-[acp] synthase (see UniProtKB Accession No. Q8PNE8 (SEQ ID NO: 16)).

In some embodiments, a 3-hydroxyacyl-CoA dehydrogenase may be classified, for example, under EC 1.1.1.-, such as, for example, EC 1.1.1.35, EC 1.1.1.36, or EC 1.1.1.157. In some embodiments, a 3-hydroxyacyl-CoA dehydrogenase may be classified under EC 1.1.1.35, such as the gene product of fadB (e.g., a *Staphylococcus aureus* 3-hydroxyacyl-CoA dehydrogenase (see UniProtKB Accession No. Q93SM2 (SEQ ID NO: 2)). In some embodiments, a 3-hydroxyacyl-CoA dehydrogenase may be classified under EC 1.1.1.36, such as the gene product of phaB (e.g., *Cupriavidus necator* acetoacetyl-CoA reductase (see UniProtKB Accession No. P14697 (SEQ ID NO: 3))). A 3-hydroxyacyl-CoA dehydrogenase classified under EC 1.1.1.36 can also be referred to as a acetoacetyl-CoA reductase. See, for example, Liu & Chen, *Appl. Microbiol. Biotechnol.*, 2007, 76(5), 1153-1159; Shen et al., *Appl. Environ. Microbiol.*, 2011, 77(9), 2905-2915; or Budde et al., *J. Bacteriol.*, 2010, 192(20), 5319-5328.

In some embodiments, a 3-hydroxyacyl-CoA dehydrogenase may be classified under EC 1.1.1.157, such as the gene product of hbd (e.g., a *Clostridium acetobutylicum* 3-hydroxybutyryl-CoA dehydrogenase (see UniProtKB Accession No. P52041 (SEQ ID NO: 4)). A 3-hydroxyacyl-CoA dehydrogenase classified under EC 1.1.1.157 can also be referred to as a 3-hydroxybutyryl-CoA dehydrogenase.

In some embodiments, a 3-oxoacyl-CoA reductase may be classified, for example, under EC 1.1.1.100, such as the gene product of fabG (e.g., an *Escherichia coli* 3-oxoacyl-[acp] reductase (see UniProtKB Accession No. P0AEK2 (SEQ ID NO: 5)). See, for example, Budde et al., 2010, supra; Nomura et al., *Appl. Environ. Microbiol.*, 2005, 71(8), 4297-4306).

In some embodiments, an enoyl-CoA hydratase may be classified, for example, under EC 4.2.1.17, EC 4.2.1.119, or EC 4.2.1.150. In some embodiments, an enoyl-CoA hydratase may be classified under EC 4.2.1.17, such as the gene product of crt (e.g., a *Clostridium botulinum* enoyl-CoA hydratase (see UniProtKB Accession No. A5I6T1 (SEQ ID NO: 47)). In some embodiments, an enoyl-CoA hydratase may be classified under EC 4.2.1.119, such as the gene product of phaJ (e.g., an *Aeromonas caviae* enoyl-CoA hydratase (see UniProtKB Accession No. O32472 (SEQ ID NO: 48)) See, for example, Shen et al., 2011, supra; or Fukui et al., *J Bacteriol.*, 1998, 180(3), 667-673. In some embodiments, an enoyl-CoA hydratase may be classified under EC 4.2.1.150, such as the gene product of crt (e.g., a *Clostridium acetobutylicum* enoyl-CoA hydratase (see UniProtKB Accession No. P52046 (SEQ ID NO: 49)).

In some embodiments, an enoyl-[acp] dehydratase such as a 3-hydroxyacyl-[acp] dehydratase may be classified, for example, under EC 4.2.1.59, such as the gene product of fabZ (e.g., an *Escherichia coli* 3-hydroxyacyl-[acp] dehydratase (see UniProtKB Accession No. P0A6Q6 (SEQ ID NO: 1)).

In some embodiments, a trans-2-enoyl-CoA reductase may be classified, for example, under EC 1.3.1.- (e.g., EC 1.3.1.8, EC 1.3.1.38, or EC 1.3.1.44), such as the gene product of ter (Nishimaki et al., *J. Biochem.*, 1984, 95, 1315-1321; Shen et al., 2011, supra) or tdter (Bond-Watts et al., *Biochemistry*, 2012, 51, 6827-6837). In some embodiments, a trans-2-enoyl-CoA reductase may be classified under EC 1.3.1.44, such as the gene product of fabV (e.g., a *Treponema denticola* trans-2-enoyl-CoA reductase (see UniProtKB Accession No. Q73Q47 (SEQ ID NO: 114))) or ter (e.g., an *Euglena gracilis* trans-2-enoyl-CoA reductase (see UniProtKB Accession No. Q5EU90 (SEQ ID NO: 115))). In some embodiments, a trans-2-enoyl-CoA reductase may be classified under EC 1.3.1.38, such as the gene product of MSMEG_2155 (e.g., a *Mycobacterium smegmatis* trans-2-enoyl-CoA reductase (see UniProtKB Accession No. AOQUC2 (SEQ ID NO: 7)).

In some embodiments, an enoyl-[acp] reductase may be classified, for example, under EC 1.3.1.9 or EC 1.3.1.10. In some embodiments, an enoyl-[acp] reductase may be classified under EC 1.3.1.9, such as the gene product of fabI (e.g., an *Escherichia coli* enoyl-[acp] reductase (see UniProtKB Accession No. P0AEK4 (SEQ ID NO: 46)). In some embodiments, an enoyl-[acp] reductase may be classified under EC 1.3.1.10, such as the gene product of fabL (e.g., a *Streptococcus pneumoniae* enoyl-[acp] reductase (see UniProtKB Accession No. A0A0X9PXJ6 (SEQ ID NO: 6)).

In some embodiments, an esterase may be classified, for example, under EC 3.1.1.1. In some embodiments, an esterase may be classified under EC 3.1.1.1, such as the gene product of ybfK (e.g., *Bacillus subtilis* esterase (see UniProtKB Accession No. O31452 (SEQ ID NO: 50)). In some embodiments, an esterase may be the gene product of estA from *Streptomyces diastatochromogenes* (see UniProtKB Accession No. Q59837 (SEQ ID NO: 51)).

Figure 4:
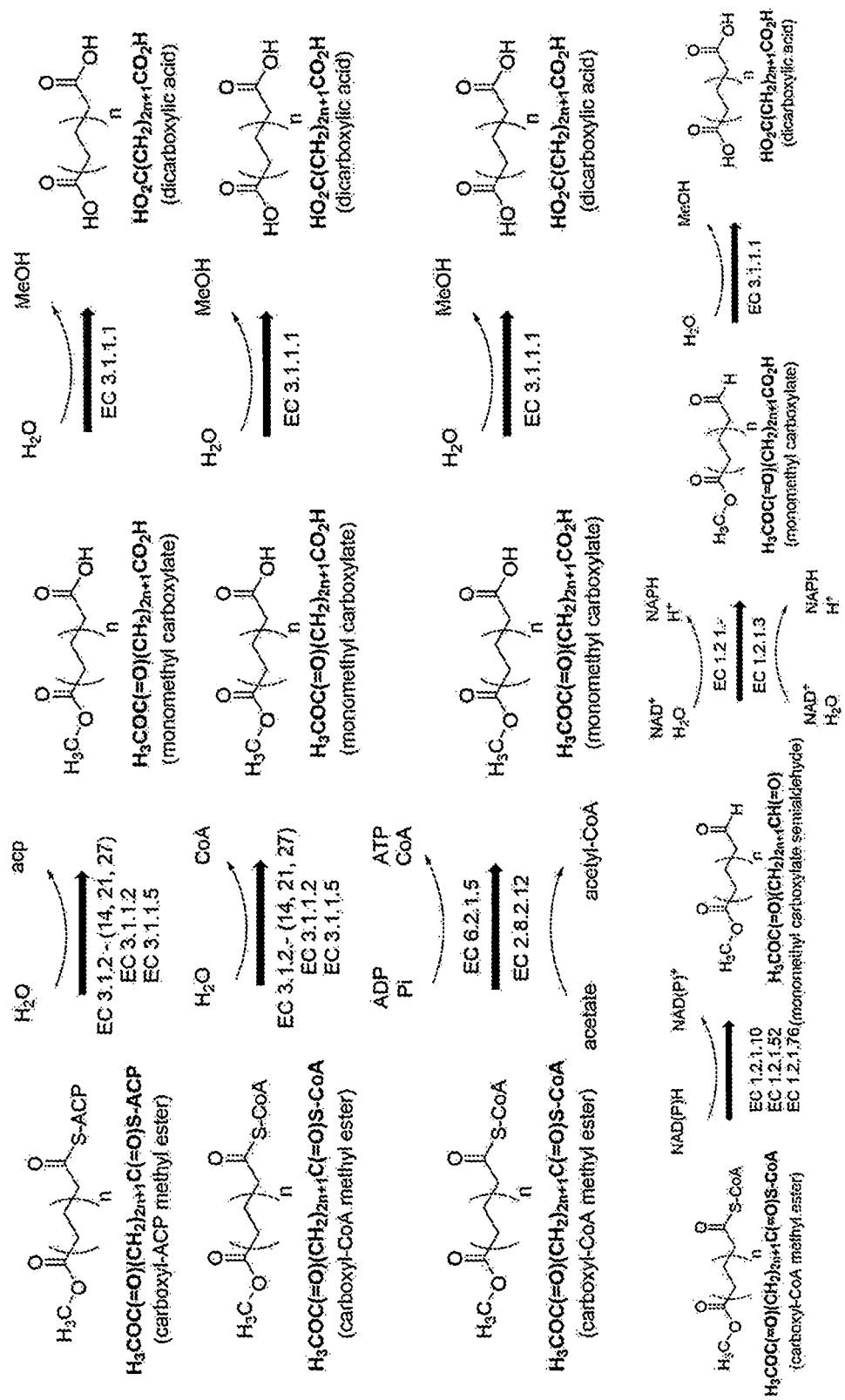
FIG. 4 is a schematic of example biochemical pathways leading to a dicarboxylic acid having an odd number of carbon atoms using a carboxyl-[acp] methyl ester, a carboxyl-CoA methyl ester, or a monomethyl carboxylate semialdehyde as central precursors.
Figure 5:
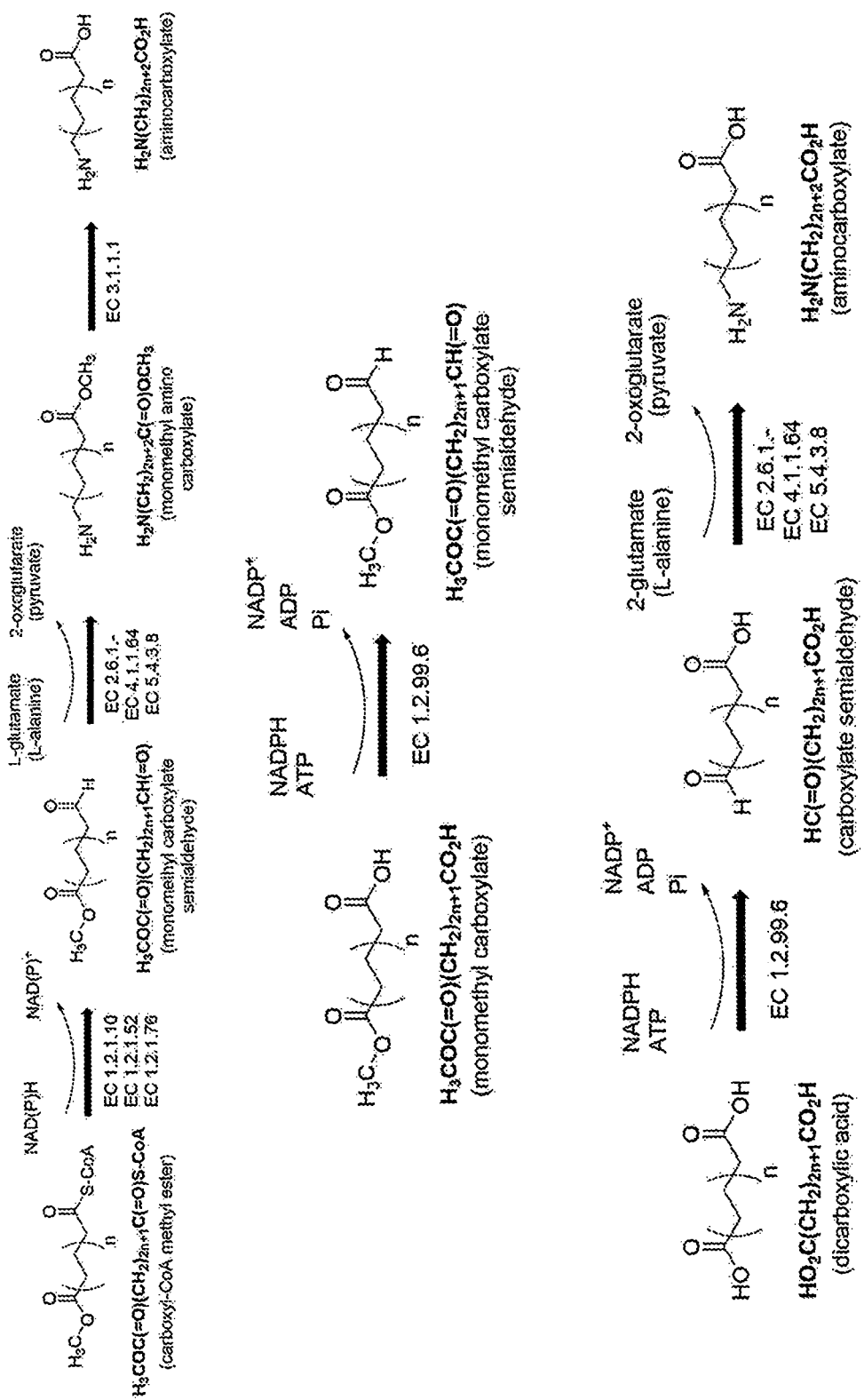
FIG. 5 is a schematic of example biochemical pathways leading to an aminocarboxylate having an odd number of carbon atoms using a carboxyl-CoA methyl ester, a monomethyl carboxylate, a monomethyl carboxylate semialdehyde, a monomethyl aminocarboxylate, or a dicarboxylic acid as central precursors.
Figure 6A:
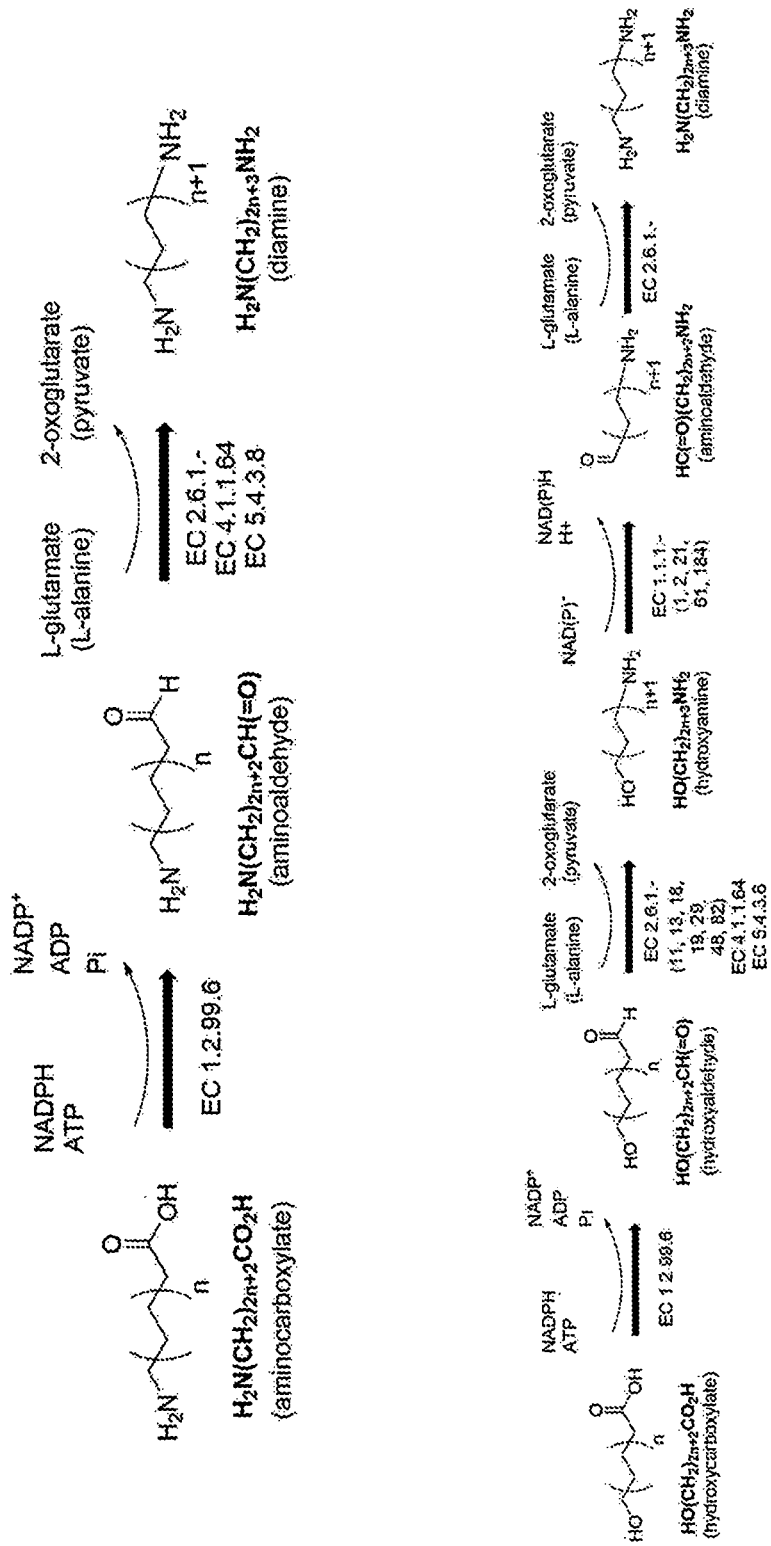
FIGS. 6A and 6B are schematics of example biochemical pathways leading to a diamine having an odd number of carbon atoms using an aminocarboxylate, a hydroxycarboxylate, or a carboxylate semialdehyde as central precursors.
Figure 6B:
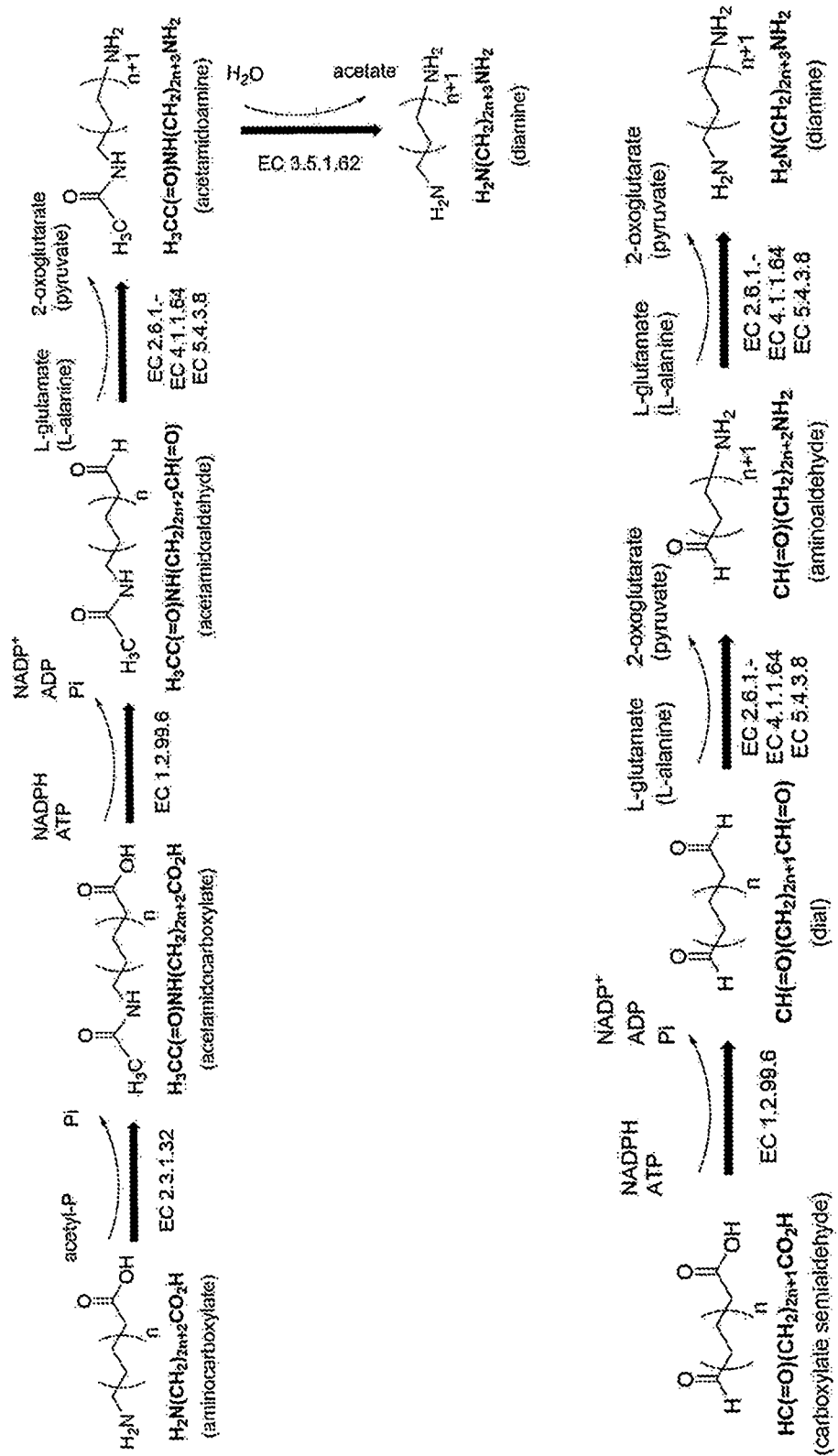

Enzymes Generating Terminal Carboxyl Groups in the Biosynthesis of $C_{2n+3}$ Building Blocks As depicted in FIG. 4, a terminal carboxyl group can be enzymatically formed using one or more polypeptides having the activity of one or more of a thioesterase, an aldehyde dehydrogenase, a 7-oxoheptanoate dehydrogenase, a 6-oxohexanoate dehydrogenase, a CoA-transferase, or a reversible CoA-ligase, enzymatically forming a monomethyl carboxylate $H_3COC(=O)(CH_2)_{2n+1}CO_2H$ from a $C_{2n+3}$ aliphatic backbone $H_3COC(=O)(CH_2)_{2n+1}C(=O)S\text{-}ACP$ or $H_3COC(=O)(CH_2)_{2n+1}C(=O)S\text{—}CoA$, wherein n is an integer greater than or equal to one, such as, for example, one, two, three, four, five, six, seven, or eight.

In some embodiments, the second terminal carboxyl group leading to the synthesis of a $C_{2n+3}$ building block is enzymatically formed by a polypeptide having the activity of a thioesterase classified, for example, under EC 3.1.1.2, EC 3.1.1.5, EC 3.1.2.-, such as EC 3.1.2.14, EC 3.1.2.21, or EC 3.1.2.27. See, for example, Cantu et al., *Protein Science*, 2010, 19, 1281-1295; Zhuang et al., *Biochemistry*, 2008, 47(9), 2789-2796; or Naggert et al., *J Biol. Chem.*, 1991, 266(17), 11044-11050).

In some embodiments, a polypeptide having the activity of a thioesterase classified under EC 3.1.2.-may be selected from: a *Spongiibacter* sp. IMCC21906 thioesterase (see UniProtKB Accession No. A0A0F7M706 (SEQ ID NO: 58)); an *Escherichia coli* O6:H1 (strain CFT073/ATCC 700928/UPEC) thioesterase (see UniProtKB Accession No. P0ADA2 (SEQ ID NO: 59)); an *Escherichia coli* thioesterase (see UniProtKB Accession No. P0A8Z3 (SEQ ID NO: 60)); a *Congregibacter litoralis* KT71 thioesterase (see UniProtKB Accession No. A4A3N9 (SEQ ID NO: 61)); a *Cuphea hookeriana* thioesterase (see UniProtKB Accession No. Q39514 (SEQ ID NO: 62)); an *Umbellutaria californica* thioesterase (see UniProtKB Accession No. Q41634 (SEQ ID NO: 63)); a *Bacillus subtilis* thioesterase (see UniProtKB Accession No. P49851 (SEQ ID NO: 64)); a *Bacillus subtilis* thioesterase (see UniProtKB Accession No. Q45061 (SEQ ID NO: 65)); a *Bacillus subtilis* thioesterase (see UniProtKB Accession No. P14205 (SEQ ID NO: 66)); and a *Homo sapiens* thioesterase encoded by ACOT13 (see UniProtKB Accession No. Q9NPJ3 (SEQ ID NO: 67)). In some embodiments, a polypeptide having the activity of a thioesterase classified under EC 3.1.2.-may be a *Spongiibacter* sp. IMCC21906 thioesterase (see UniProtKB Accession No. A0A0F7M706 (SEQ ID NO: 58)) or an *Escherichia coli* O6:H1 (strain CFT073/ATCC 700928/UPEC) thioesterase (see UniProtKB Accession No. P0ADA2 (SEQ ID NO: 59)).

In some embodiments, a polypeptide having the activity of a thioesterase classified under EC 3.1.2.-may be an *Escherichia coli* thioesterase (see UniProtKB Accession No. P0A8Z3 (SEQ ID NO: 60)) or a *Congregibacter litoralis* KT71 thioesterase (see UniProtKB Accession No. A4A3N9 (SEQ ID NO: 61)).

In some embodiments, a polypeptide having the activity of a thioesterase classified under EC 3.1.2.14 may be selected from a *Agathobacter rectalis* DSM 17629 thioesterase (see UniProtKB Accession No. D6E2B1 (SEQ ID NO: 68)); a *Lactobacills plantarum* thioesterase (see UniProtKB Accession No. F9ULU3 (SEQ ID NO: 69)); a *Desulfovibrio piezophilus* thioesterase (see UniProtKB Accession No. M1WJV0 (SEQ ID NO: 70)); and a *Streptococcus dysgalactiae* thioesterase (see UniProtKB Accession No. C5WH65 (SEQ ID NO: 71)). In some embodiments, a polypeptide having the activity of a thioesterase classified under EC 3.1.2.14 may be a *Agathobacter rectalis* DSM 17629 thioesterase (see UniProtKB Accession No. D6E2B1 (SEQ ID NO: 68)).

In some embodiments, a polypeptide having the activity of a thioesterase may be selected from: a *Terrisporobacter othiniensis* thioesterase (see UniProtKB Accession No. A0A0B3WUQ1 (SEQ ID NO: 72)); a *Thalassospira xiamnenensis* M-5 thioesterase (see UniProtKB Accession No. A0A0B4Y4H4 (SEQ ID NO: 73)); a *Cellulosilyticum lentocellum* thioesterase (see UniProtKB Accession No. F2JLT2 (SEQ ID NO: 74)); a *Clostridium thermocellum* thioesterase (see UniProtKB Accession No. A3DJY9 (SEQ ID NO: 75)); a *Thermovirga lienii* thioesterase (see UniProtKB Accession No. G7V8P3 (SEQ ID NO: 76)); a *Spirochaeta smaragdinae* thioesterase (see UniProtKB Accession No. E1RAP4 (SEQ ID NO: 77)); an *Opitutus terrae* thioesterase (see UniProtKB Accession No. B1ZXQ1 (SEQ ID NO: 78)); a *Thermincola potens* thioesterase (see UniProtKB Accession No. D5XAN2 (SEQ ID NO: 79)); a *Clostridium* sp. CAG:306 thioesterase (see UniProtKB Accession No. R6Q7V8 (SEQ ID NO: 80)); a *Citrobacter rodentium* thioesterase (see UniProtKB Accession No. D2TLW8 (SEQ ID NO: 81)); a *Vibrio shilonii* AK1 thioesterase (see UniProtKB Accession No. A6D1N2 (SEQ ID NO: 82)); a *Pseudomonas putida* CSV86 thioesterase (see UniProtKB Accession No. L1M6X0 (SEQ ID NO: 83)); an *Alteromonas australica* thioesterase (see UniProtKB Accession No. A0A075P0V4 (SEQ ID NO: 84)); a *Ferrimonas balearica* thioesterase (see UniProtKB Accession No. E1SPF5 (SEQ ID NO: 85)); a *Marine sediment metagenome* thioesterase (see UniProtKB Accession No. A0A0F9W7B7 (SEQ ID NO: 86)); a *Shimwellia blattae* thioesterase (see UniProtKB Accession No. I2BBI6 (SEQ ID NO: 87)); a *Clostridium sulfidigenes* thioesterase (see UniProtKB Accession No. A0A084JBW2 (SEQ ID NO: 88)); a *Clostridium cellulolyticum* thioesterase (see UniProtKB Accession No. B81625 (SEQ ID NO: 89)); a *Clostridium argentinense* thioesterase (see UniProtKB Accession No. A0A0C1QZB7 (SEQ ID NO: 90)); a *Cryptobacterium curtum* thioesterase (see UniProtKB Accession No. C7ML86 (SEQ ID NO: 91)); a *Treponema primitia* thioesterase (see UniProtKB Accession No. F5YIQ3 (SEQ ID NO: 92)); a *Oceanimonas* sp. thioesterase (see UniProtKB Accession No. H2FZ27 (SEQ ID NO: 93)); a *Paenibacillus* sp. IHBB 10380 thioesterase (see UniProtKB Accession No. A0A0D3V4E9 (SEQ ID NO: 94)); an *Aerococcus viridans* ATCC 11563 thioesterase (see UniProtKB Accession No. D4YGM6 (SEQ ID NO: 95)); a *Lactococcus raffinolactis* 4877 thioesterase (see UniProtKB Accession No. I7KI30 (SEQ ID NO: 96)); a *Catabacter hongkongensis* thioesterase (see UniProtKB Accession No. A0A0M2NEM6 (SEQ ID NO: 97)); a *Lactobacillus ruminis* SPM0211 thioesterase (see UniProtKB Accession No. F7R2D3 (SEQ ID NO: 98)); a *Clostridium* sp. DMHC 10 thioesterase (see UniProtKB Accession No. A0A0L8EW05 (SEQ ID NO: 99)); a *Clostridiales bacterium* oral taxon 876 str. F0540 thioesterase (see UniProtKB Accession No. U2CXE7 (SEQ ID NO: 100)); a *Clostridium novyi* thioesterase (see UniProtKB Accession No. A0PXB0 (SEQ ID NO: 101)); a *Peptoniphilus harei* ACS-146-V-Sch2b thioesterase (see UniProtKB Accession No. E4L0C9 (SEQ ID NO: 102)); a *Lactobacillus brevis* thioesterase (see UniProtKB Accession No. Q03SR8 (SEQ ID NO: 103)); a *Lactobacillus delbrueckii* thioesterase (see UniProtKB Accession No. WP_011678490.1, (SEQ ID NO: 104)); a *Clostridium perfringens* thioesterase (see GenBank Accession No. WP_011591187.1 (SEQ ID NO: 105)); a *Treponema azatonutricium* thioesterase (see UniProtKB Accession No. F5YA29 (SEQ ID NO: 106)); a *Hungatella hathewayi* thioesterase (see GenBank Accession No. ENY95204.1 (SEQ ID NO: 107)); a *Bacillus coagulans* thioesterase (see UniProtKB Accession No. F7Z1I0 (SEQ ID NO: 108)); a *Bdellovibrio bacteriovorus* thioesterase (see UniProtKB Accession No. Q6MKA8 (SEQ ID NO: 109)); a *Treponema denticola* thioesterase (see GenBank Accession No. WP_002688506.1 (SEQ ID NO: 110)); a *Paenibacillus lactis* thioesterase (see UniProtKB Accession No. G4HNN3 (SEQ ID NO: 111)); a *Cuphea palustris* thioesterase (see UniProtKB Accession No. Q39554 (SEQ ID NO: 112)); and a *Escherichia coli* thioesterase encoded by yciA (see UniProtKB Accession No. B1LH39 (SEQ ID NO: 113)).

In some embodiments, a polypeptide having the activity of a thioesterase may be selected from: a *Terrisporobacter othiniensis* thioesterase (see UniProtKB Accession No. A0A0B3WUQ1 (SEQ ID NO: 72)); a *Thalassospira xiamenensis* M-5 thioesterase (see UniProtKB Accession No. A0A0B4Y4H4 (SEQ ID NO: 73)); and a *Cellulosilyticum lentocellum* thioesterase (see UniProtKB Accession No. F2JLT2 (SEQ ID NO: 74)).

In some embodiments, a polypeptide having the activity of a thioesterase may be selected from: a *Clostridium thermocellum* thioesterase (see UniProtKB Accession No. A3DJY9 (SEQ ID NO: 75)); a *Thermovirga lienii* thioesterase (see UniProtKB Accession No. G7V8P3 (SEQ ID NO: 76)); and a *Spirochaeta smaragdinae* thioesterase (see UniProtKB Accession No. E1RAP4 (SEQ ID NO: 77)).

In some embodiments, a polypeptide having the activity of a thioesterase may be selected from: an *Opitutus terrae* thioesterase (see UniProtKB Accession No. B1ZXQ1 (SEQ ID NO: 78)); a *Thermincola potens* thioesterase (see UniProtKB Accession No. D5XAN2 (SEQ ID NO: 79)); a *Clostridium* sp. CAG:306 thioesterase (see UniProtKB Accession No. R6Q7V8 (SEQ ID NO: 80)); a *Citrobacter rodentium* thioesterase (see UniProtKB Accession No. D2TLW8 (SEQ ID NO: 81)); a *Vibrio shilonii* AK1 thioesterase (see UniProtKB Accession No. A6D1N2 (SEQ ID NO: 82)); a *Pseudomonas putida* CSV86 thioesterase (see UniProtKB Accession No. L1M6X0 (SEQ ID NO: 83)); an *Alteromonas* australica thioesterase (see UniProtKB Accession No. A0A075P0V4 (SEQ ID NO: 84)); a *Ferrimonas balearica* thioesterase (see UniProtKB Accession No. E1SPF5 (SEQ ID NO: 85)); a *Marine sediment metagenome* thioesterase (see UniProtKB Accession No. A0A0F9W7B7 (SEQ ID NO: 86)); and a *Shimwellia blattae* thioesterase (see UniProtKB Accession No. I2BBI6 (SEQ ID NO: 87)).

In some embodiments, a polypeptide having the activity of a thioesterase may be selected from: a *Clostridium sulfidigenes* thioesterase (see UniProtKB Accession No.

A0A084JBW2 (SEQ ID NO: 88)); a *Clostridium cellulolyticum* thioesterase (see UniProtKB Accession No. B81625 (SEQ ID NO: 89)); a *Clostridium argentinense* thioesterase (see UniProtKB Accession No. A0A0C1QZB7 (SEQ ID NO: 90)); a *Cryptobacterium curtum* thioesterase (see UniProtKB Accession No. C7ML86 (SEQ ID NO: 91)); a *Treponema primitia* thioesterase (see UniProtKB Accession No. F5YIQ3 (SEQ ID NO: 92)); a *Oceanimonas* sp. thioesterase (see UniProtKB Accession No. H2FZ27 (SEQ ID NO: 93)); a *Paenibacillus* sp. IHBB 10380 thioesterase (see UniProtKB Accession No. A0A0D3V4E9 (SEQ ID NO: 94)); an *Aerococcus viridans* ATCC 11563 thioesterase (see UniProtKB Accession No. D4YGM6 (SEQ ID NO: 95)); a *Lactococcus raffinolactis* 4877 thioesterase (see UniProtKB Accession No. I7KI30 (SEQ ID NO: 96)); a *Catabacter hongkongensis* thioesterase (see UniProtKB Accession No. A0A0M2NEM6 (SEQ ID NO: 97)); a *Lactobacillus ruminis* SPM0211 thioesterase (see UniProtKB Accession No. F7R2D3 (SEQ ID NO: 98)); a *Clostridium* sp. DMHC 10 thioesterase (see UniProtKB Accession No. A0A0L8EW05 (SEQ ID NO: 99)); a *Clostridiales bacterium* oral taxon 876 str. F0540 thioesterase (see UniProtKB Accession No. U2CXE7 (SEQ ID NO: 100)); and a *Clostridium novyi* thioesterase (see UniProtKB Accession No. A0PXB0 (SEQ ID NO: 101)).

In some embodiments, a polypeptide having the activity of a thioesterase may be a *Peptoniphilus harei* ACS-146-V-Sch2b thioesterase (see UniProtKB Accession No. E4L0C9 (SEQ ID NO: 102)).

In some embodiments, a polypeptide having the activity of a thioesterase may be a *Firmicutes bacterium* CAG:449 thioesterase (see UniProtKB Accession No. R6RDZ9 (SEQ ID NO: 182)), *Clostridium* sp. CAG: 798 thioesterase (see UniProtKB Accession No. R6XLC3 (SEQ ID NO: 183)), [*Clostridium*] *ultunense* Esp thioesterase (see UniProtKB Accession No. M1Z1V0 (SEQ ID NO: 184)), *Granulicatella elegans* ATCC 700633 thioesterase (see UniProtKB Accession No. D0BKN0 (SEQ ID NO: 185)), *Haemophilus influenzae* (strain A TCC 51907/DSM 11121/KW20/Rd) thioesterase (see UniProtKB Accession No. P44886 (SEQ ID NO: 186)), *Eggerthella* sp. CAG:1427 thioesterase (see UniProtKB Accession No. R5FQ35 (SEQ ID NO: 187)), *Vibrio mimicus* thioesterase (see UniProtKB Accession No. Q07792 (SEQ ID NO: 188)), *Sedimenticola thiotaurini* thioesterase (see UniProtKB Accession No. A0A0F7JXA5 (SEQ ID NO: 189)), *Bacteroides finegoldii* CL09T03C10 thioesterase (see UniProtKB Accession No. K5D7V3 (SEQ ID NO: 190)), *Pseudoalteromonas* sp. SW0106-04 thioesterase (see UniProtKB Accession No. A0A0M9UHQ1 (SEQ ID NO: 191)), *Vibrio mytili* thioesterase (see UniProtKB Accession No. A0A0C3EBX5 (SEQ ID NO: 192)), *Pseudomonas fluorescens* thioesterase (see UniProtKB Accession No. A0A0B7DFD2 (SEQ ID NO: 193)), *Pseudomonas stutzeri* (strain A1501) thioesterase (see UniProtKB Accession No. A4VL40 (SEQ ID NO: 194)), or *Halobacteriovorax marinus* (strain ATCC BAA-682/DSM 15412/SJ) (*Bacteriovorax marinus*) thioesterase (see UniProtKB Accession No. E1WY53 (SEQ ID NO: 195)).

In some embodiments, a terminal formyl group leading to the synthesis of a dicarboxylic acid $HO_2C(CH_2)_{2n+1}CO_2H$, wherein n is an integer greater than or equal to one, such as, for example, one, two, three, four, five, six, seven, or eight, is enzymatically formed by a polypeptide having the activity of an acetylating aldehyde dehydrogenase classified, for example, under EC 1.2.1.10, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52. In some embodiments, a polypeptide having the activity of an acetylating aldehyde dehydrogenase classified under EC 1.2.1.10 is the gene product of pduP (e.g., a *Salmonella typhimurium* acetylating aldehyde dehydrogenase (see UniProtKB Accession No. H9L416 (SEQ ID NO: 18))). In some embodiments, a polypeptide having the activity of an acetylating aldehyde dehydrogenase is the gene product of pduB (e.g., a *Salmonella typhimurium* acetylating aldehyde dehydrogenase (see UniProtKB Accession No. P37449 (SEQ ID NO: 19))). See, for example, Lan et al., 2013, *Energy Environ. Sci.*, 6:2672-2681.

In some embodiments, the first terminal carboxyl group leading to the synthesis of a dicarboxylic acid $HO_2C(CH_2)_{2n+1}CO_2H$, wherein n is an integer greater than or equal to one, such as, for example, one, two, three, four, five, six, seven, or eight, is enzymatically formed by a polypeptide having the activity of an aldehyde dehydrogenase classified, for example, under EC 1.2.1.3. See, for example, Guerrillot & Vandecasteele, *Eur. J. Biochem.*, 1977, 81, 185-192. In some embodiments, a polypeptide having the activity of an aldehyde dehydrogenase classified under EC 1.2.1.3 may be a *Kibdelosporangium* sp. aldehyde dehydrogenase (see UniProtKB Accession No. A0A0K3BN67 (SEQ ID NO: 24)).

In some embodiments, the first terminal carboxyl group leading to the synthesis of a dicarboxylic acid $HO_2C(CH_2)_{2n}+CO_2H$, wherein n is an integer greater than or equal to one, such as, for example, one, two, three, four, five, six, seven, or eight, is enzymatically formed by a polypeptide having the activity of dehydrogenase classified, for example, under EC 1.2.1.-. In some embodiments, a dehydrogenase may be a 6-oxohexanoate dehydrogenase classified, for example, under EC 1.2.1.- (e.g., EC 1.2.1.63), such as the gene product of chnE (e.g., an *Acinetobacter* sp. 6-oxohexanoate dehydrogenase (see UniProtKB Accession No. Q9R2F4 (SEQ ID NO: 9)) or a *Rhodococcus* sp. 6-oxohexanoate dehydrogenase (see UniProtKB Accession No. Q6RXW0 (SEQ ID NO: 10))). In some embodiments, a dehydrogenase may be a 7-oxoheptanoate dehydrogenase classified, for example, under EC 1.2.1.-, such as the gene product of chnE (e.g., an *Acinetobacter* sp. 7-oxoheptanoate dehydrogenase (see UniProtKB Accession No. Q9R2F4 (SEQ ID NO: 12)) or a *Rhodococcus* sp. 7-oxoheptanoate dehydrogenase (see UniProtKB Accession No. Q6RXW0 (SEQ ID NO: 13))). See, for example, Iwaki et al., *Appl. Environ. Microbiol.*, 1999, 65(11), 5158-5162; or López-Sánchez et al., *Appl. Environ. Microbiol.*, 2010, 76(1), 110-118. In some embodiments, a dehydrogenase may be a non-acylating NAD-dependent aldehyde dehydrogenase, such as, for example, the gene product of thnG (e.g., a *Sphingomonas macrogolitabida* 7-oxoheptanoate dehydrogenase (see UniProtKB Accession No. D9PTN3 (SEQ ID NO: 11))).

In some embodiments, the first terminal carboxyl group leading to the synthesis of dicarboxylic acid $HO_2C(CH_2)_{2n+1}CO_2H$, wherein n is an integer greater than or equal to one, such as, for example, one, two, three, four, five, six, seven, or eight, is enzymatically formed by a polypeptide having the activity of CoA-transferase (e.g., a glutaconate CoA-transferase) classified, for example, under EC 2.8.3.12, such as the gene product of gctAB (e.g., an *Acidaminococcus fermentans* glutaconate CoA-transferase (see UniProtKB Accession No. Q59111 (SEQ ID NO: 40) and UniProtKB Accession No. Q59112 (SEQ ID NO: 41))). See, for example, Buckel et al., 1981, *Eur. J. Biochem.*, 118:315-321.

In some embodiments, the first terminal carboxyl group leading to the synthesis of a dicarboxylic acid $HO_2C(CH_2)_{2n+1}CO_2H$, wherein n is an integer greater than or equal to one, such as, for example, one, two, three, four, five, six, seven, or eight, is enzymatically formed by a polypeptide having the activity of reversible CoA-ligase (e.g., a succinate-CoA ligase) classified, for example, under EC 6.2.1.5, such as a *Thermococcus kodakaraensis* succinate-CoA-ligase. See, for example, Shikata et al., 2007, *J. Biol. Chem.*, 282(37):26963-26970.

In some embodiments, the second terminal carboxyl group leading to the synthesis of a dicarboxylic acid $HO_2C(CH_2)_{2n+1}CO_2H$, wherein n is an integer greater than or equal to one, such as, for example, one, two, three, four, five, six, seven, or eight, is enzymatically formed by a polypeptide having the activity of an esterase (e.g., a carboxylesterase) classified, for example, under EC 3.1.1.1. See, for example, Kunst et al., 1997, *Nature*, 390 (6657), 249-256. In some embodiments, a polypeptide having the activity of an esterase classified under EC 3.1.1.1 may be the gene product of ybfK (e.g., a *Bacillus subtilis* esterase (see UniProtKB Accession No. O31452 (SEQ ID NO: 50))). In some embodiments, a polypeptide having the activity of an esterase may be the gene product of estA (e.g., a *Streptomyces diastatochromogenes* esterase (see UniProtKB Accession No. Q59837 (SEQ ID NO: 51)).

Enzymes Generating Terminal Amine Groups in the Biosynthesis of $C_{2n+3}$ Building Blocks As depicted in FIGS. 3 and 4, terminal amine groups can be enzymatically formed using a polypeptide having the activity of an aminotransferase or a deacetylase.

In some embodiments, a terminal amine group leading to the synthesis of 7-aminoheptanoic acid is enzymatically formed by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, such as, for example, the amino acid sequences of any one of SEQ ID NOs: 116-138 or SEQ ID NOs: 167-181. Some of these aminotransferases are diamine w-transaminases (e.g., an *Escherichia coli* aminotransferase (see UniProtKB Accession No. P42588 (SEQ ID NO: 119)). For example, the aminotransferases classified, for example, under EC 2.6.1.29 or EC 2.6.1.82 may be diamine co-transaminases.

The reversible aminotransferase from *Chromobacterium violaceum* (see UniProtKB Accession No. Q7NWG4 (SEQ ID NO: 116)) has demonstrated analogous activity accepting 6-aminohexanoic acid as amino donor, thus forming the first terminal amine group in adipate semialdehyde (Kaulmann et al., *Enzyme and Microbial Technology*, 2007, 41, 628-637).

The reversible 4-aminobutyrate:2-oxoglutarate transaminase from *Streptomyces griseus* has demonstrated analogous activity for the conversion of 6-aminohexanoate to adipate semialdehyde (Yonaha et al., *Eur. J. Biochem.*, 1985, 146: 101-106).

The reversible 5-aminovalerate transaminase from *Clostridium viride* has demonstrated analogous activity for the conversion of 6-aminohexanoate to adipate semialdehyde (Barker et al., *J Biol. Chem.*, 1987, 262(19), 8994-9003).

In some embodiments, a terminal amine group leading to the synthesis of an aminocarboxylate $H_2N(CH_2)_{2n+2}CO_2H$ or a diamine $H_2N(CH_2)_{2n+3}NH_2$, wherein n is an integer greater than or equal to one, such as, for example, one, two, three, four, five, six, seven, or eight, is enzymatically formed by a polypeptide having the activity of a diamine ω-transaminase. For example, the second terminal amine group can be enzymatically formed by a polypeptide having the activity of a diamine ω-transaminase classified, for example, under EC 2.6.1.29 or classified, for example, under EC 2.6.1.82, such as the gene product of ygjG from *E. coli* (e.g., an *Escherichia coli* aminotransferase (see UniProtKB Accession No. P42588 (SEQ ID NO: 119)).

The gene product of ygjG accepts a broad range of diamine carbon chain length substrates, such as putrescine, cadaverine, and spermidine (see, for example, Samsonova et al., *BMC Microbiology*, 2003, 3:2).

The diamine co-transaminase from *E. coli* strain B has demonstrated activity for 1,7 diaminoheptane (Kim, *The Journal of Chemistry*, 1964, 239(3), 783-786).

In some embodiments, an aminotransferase classified under EC 2.6.1.-may be a *Chromobacterium violaceum* aminotransferase (see UniProtKB Accession No. Q7NWG4 (SEQ ID NO: 116)), a *Thermomicrobium roseum* aminotransferase (see UniProtKB Accession No. B9L0N2 (SEQ ID NO: 117)) or a *Nautella italica* aminotransferase (see UniProtKB Accession No. A0A0H5D6A2 (SEQ ID NO: 118)).

In some embodiments, an aminotransferase may be selected from: a *Kiloniella spongiae* aminotransferase (see UniProtKB Accession No. A0A0H2MDD9 (SEQ ID NO: 120)); a *Haematobacter missouriensis* aminotransferase (see UniProtKB Accession No. A0A086YIZ0 (SEQ ID NO: 121)); a *Mesorhizobium* sp. LC103 aminotransferase (see UniProtKB Accession No. A0A0H1AH98 (SEQ ID NO: 122)); a *Pseudomonas* sp. 10-1B aminotransferase (see UniProtKB Accession No. A0A0E9ZHQ3 (SEQ ID NO: 123)); a *Mesorhizobium alhagi* aminotransferase (see UniProtKB Accession No. H0I025 (SEQ ID NO: 124)); a *Pseudomonas aeruginosa* aminotransferase (see UniProtKB Accession No. Q9HV04 (SEQ ID NO: 125)); a *Pseudomonas syringae* aminotransferase (see UniProtKB Accession No. Q4ZLS9 (SEQ ID NO: 126)); a *Rhodobacter sphaeroides* aminotransferase (see UniProtKB Accession No. Q3IWE9 (SEQ ID NO: 127)); a *Vibrio fluvialis* aminotransferase (see UniProtKB Accession No. F2XBU9 (SEQ ID NO: 128)); a *Lutibaculum baratangense* AMV1 aminotransferase (see UniProtKB Accession No. V4RM39 (SEQ ID NO: 129)); a *Truepera radiovictrix* aminotransferase (see UniProtKB Accession No. D7CVJ6 (SEQ ID NO: 130)); an *Aquamicrobium defluvii* aminotransferase (see UniProtKB Accession No. A0A011UWB9 (SEQ ID NO: 131)); a *Neorhizobium galegae* by. *orientalis* str. HAMBI 540 aminotransferase (see UniProtKB Accession No. A0A068SUV9 (SEQ ID NO: 132)); a *Microvirga* sp. BSC39 aminotransferase (see UniProtKB Accession No. A0A086MKC4 (SEQ ID NO: 133)); a *Mesorhizobium* sp. LC103 aminotransferase (see UniProtKB Accession No. A0A0H1A7R9 (SEQ ID NO: 134)); a *Starkeya novella* aminotransferase (see UniProtKB Accession No. D7A1Z2 (SEQ ID NO: 135)); an *Azospirillum lipoferum* aminotransferase (see UniProtKB Accession No. G7Z3P2 (SEQ ID NO: 136)); a *Variovorax* sp. CF313 aminotransferase (see UniProtKB Accession No. J2TM48 (SEQ ID NO: 137); and a *Thalassospira profundimaris* WP0211 aminotransferase (see UniProtKB Accession No. K2KXB1 (SEQ ID NO: 138)).

In some embodiments, an aminotransferase may be selected from: a *Kiloniella spongiae* aminotransferase (see UniProtKB Accession No. A0A0H2MDD9 (SEQ ID NO: 120)); a *Haematobacter missouriensis* aminotransferase (see UniProtKB Accession No. A0A086YIZ0 (SEQ ID NO:

121)); and a *Mesorhizobium* sp. LC103 aminotransferase (see UniProtKB Accession No. A0A0H1AH98 (SEQ ID NO: 122)).

In some embodiments, an aminotransferase may be selected from: a *Pseudomonas* sp. 10-1B aminotransferase (see UniProtKB Accession No. A0A0E9ZHQ3 (SEQ ID NO: 123)); a *Mesorhizobium alhagi* aminotransferase (see UniProtKB Accession No. H0I025 (SEQ ID NO: 124); a *Thermomicrobium roseum* aminotransferase (see UniProtKB Accession No. B9L0N2 (SEQ ID NO: 117)); and a *Chromobacterium violaceum* aminotransferase (see UniProtKB Accession No. Q7NWG4 (SEQ ID NO: 116)).

In some embodiments, an aminotransferase may be selected from a: *Vibrio fluvialis* aminotransferase (see UniProtKB Accession No. F2XBU9 (SEQ ID NO: 167)); *Rhodospirillum centenum* (strain ATCC 51521/SW) aminotransferase (see UniProtKB Accession No. B6ISI5 (SEQ ID NO: 168)); *Marine sediment metagenome* aminotransferase (see UniProtKB Accession No. A0A0F9UFF8 (SEQ ID NO: 169)); *Acidimicrobium ferrooxidans* (strain DSM 10331/JCM 15462/NBRC 103882/ICP) aminotransferase (see UniProtKB Accession No. C7LZG4 (SEQ ID NO: 170)); *Tistrella mobilis* (strain KA081020-065) aminotransferase (see UniProtKB Accession No. I3TH77 (SEQ ID NO: 171)); *Pseudomonas taiwanensis* SJ9 aminotransferase (see UniProtKB Accession No. V7D492 (SEQ ID NO: 172)); *Methylobacterium aquaticum* aminotransferase (see UniProtKB Accession No. A0A0C6G014 (SEQ ID NO: 173)); *Candida tenuis* (strain ATCC 10573/BCRC 21748/CBS 615/JCM 9827/NBRC 10315/NRRL Y-1498/VKM Y-70) (Yeast) aminotransferase (see UniProtKB Accession No. G3BAK1 (SEQ ID NO: 174)); *Tepidicaulis marinus* aminotransferase (see UniProtKB Accession No. A0A081B6K8 (SEQ ID NO: 175)); *Firmicutes bacterium* CAG:24 aminotransferase (see UniProtKB Accession No. R5HDC3 (SEQ ID NO: 176)); *Pseudooceanicola batsensis* (strain ATCC BAA-863/DSM 15984/KCTC 12145/HTCC2597) (*Oceanicola batsensis*) aminotransferase (see UniProtKB Accession No. A3U3W9 (SEQ ID NO: 177)); *Defluviimonas* sp. 20V17 aminotransferase (see UniProtKB Accession No. A0A059IS31 (SEQ ID NO: 178)); *Sphingobacterium spiritivorum* ATCC 33861 aminotransferase (see UniProtKB Accession No. D7VKX2 (SEQ ID NO: 179)); *Ramlibacter tataouinensis* (strain ATCC BAA-407/DSM 14655/LMG 21543/TTB310) aminotransferase (see UniProtKB Accession No. F5Y1J0 (SEQ ID NO: 180)); and *Bradyrhizobium* sp. DOA9 aminotransferase (see UniProtKB Accession No. A0A061M4Q7 (SEQ ID NO: 181)).

In some embodiments, the second terminal amine group leading to the synthesis of a diamine $H_2N(CH_2)_{2n+3}NH_2$, wherein n is an integer greater than or equal to one, such as, for example, one, two, three, four, five, six, seven, or eight, is enzymatically formed by a polypeptide having the activity of deacetylase such as acetylputrescine deacetylase classified, for example, under EC 3.5.1.62. In some embodiments, an acetylputrescine deacetylase classified under EC 3.5.1.62 may be the gene product of aphA (e.g., a *Burkholderia pseudomallei* acetylputrescine deacetylase (see UniProtKB Accession No. Q3JUN4 (SEQ ID NO: 42), a *Pseudomonas aeruginosa* acetylputrescine deacetylase (see UniProtKB Accession No. Q913T5 (SEQ ID NO: 43), or a *Mycoplana ramose* acetylputrescine deacetylase (see UniProtKB Accession No. Q48935 (SEQ ID NO: 44)) or aphB (e.g., *Pseudomonas aeruginosa* acetylputrescine deacetylase (see UniProtKB Accession No. Q9I6H0 (SEQ ID NO: 45)).

The acetylputrescine deacetylase from *Micrococcus luteus* K-11 accepts a broad range of carbon chain length substrates, such as acetylputrescine, acetylcadaverine and $N^8$. acetylspermidine (see, for example, Suzuki et al., 1986, *BBA—General Subjects*, 882(1):140-142).

Figure 7:
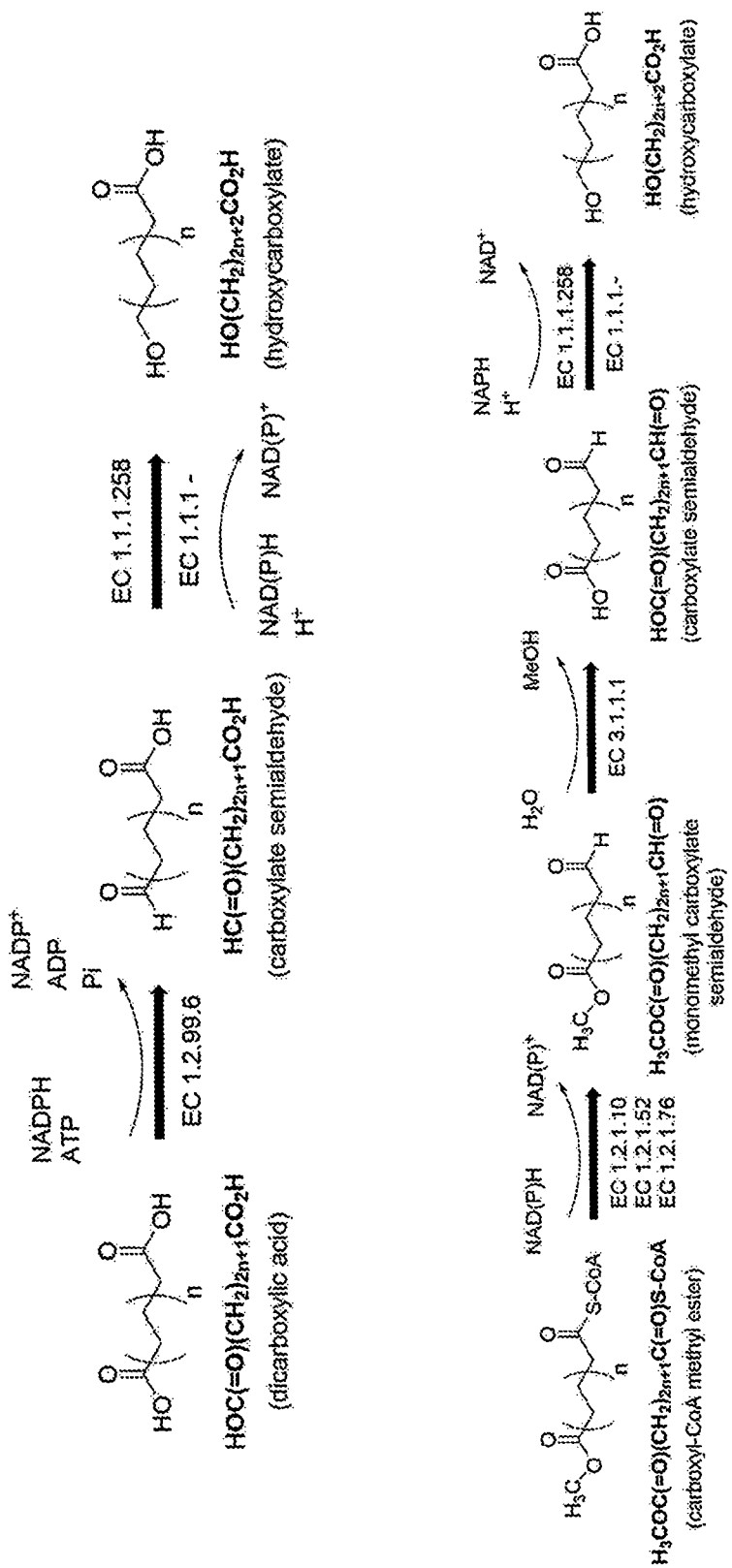
FIG. 7 is a schematic of example biochemical pathways leading to a hydroxycarboxylate having an odd number of carbon atoms using a dicarboxylic acid, a carboxy-CoA methyl ester, a monomethyl carboxylate semialdehyde, or a carboxylate semialdehyde as central precursors.
Figure 8:
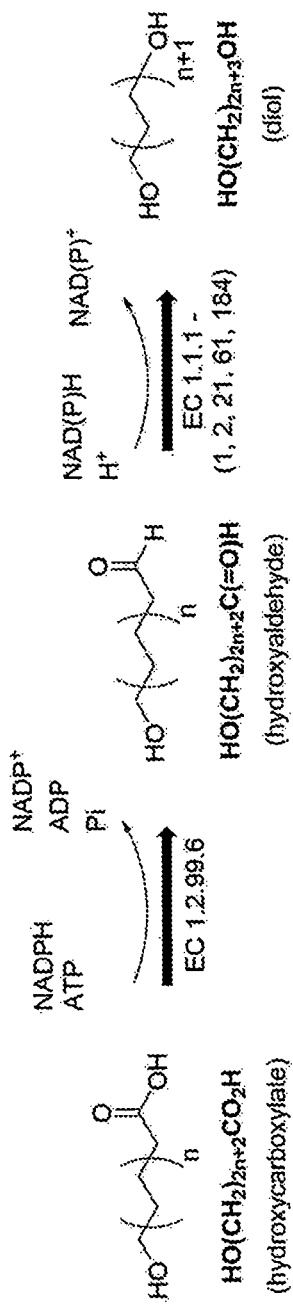
FIG. 8 is a schematic of an example biochemical pathway leading to a diol having an odd number of carbon atoms using a hydroxycarboxylate as a central precursor.

Enzymes Generating the Terminal Hydroxyl Groups in the Biosynthesis of $C_{2n+3}$ Building Blocks As depicted in FIGS. 7 and 8, a terminal hydroxyl group can be enzymatically formed using a polypeptide having the activity of an alcohol dehydrogenase.

In some embodiments, a terminal hydroxyl group leading to the synthesis of a $OH(CH_2)_{2n+3}OH$ is enzymatically formed by a polypeptide having the activity of an alcohol dehydrogenase classified, for example, under EC 1.1.1.- (e.g., 1, 2, 21, 61, 184, or 258). In some embodiments, a polypeptide having the activity of an alcohol dehydrogenase classified under EC 1.1.1.-is the gene product of yqhD (e.g., an *Escherichia coli* alcohol dehydrogenase (see UniProtKB Accession No. Q46856 (SEQ ID NO: 20))) or cpnD (e.g., *Comamonas* sp. alcohol dehydrogenase (see UniProtKB Accession No. Q8GAW4 (SEQ ID NO: 21))). See, for example, Iwaki et al., 2002, *Appl. Environ. Microbiol.*, 68(11):5671-5684. In some embodiments, a polypeptide having the activity of an alcohol dehydrogenase classified under EC 1.1.1.2 is the gene product of ADH6 (e.g., *Saccharomyces cerevisiae* alcohol dehydrogenase (see UniProtKB Accession No. Q04894 (SEQ ID NO: 22))). See, for example, Larroy et al., 2002, *Biochem J*, 361 (Pt 1), 163-172). In some embodiments, a polypeptide having the activity of an alcohol dehydrogenase classified under EC 1.1.1.61 is the gene product of gbd (e.g., *Cuprividus necator* alcohol dehydrogenase (see UniProtKB Accession No. Q59104 (SEQ ID NO: 23))). An alcohol dehydrogenase classified under EC 1.1.1.61 may also be referred to as a 4-hydroxybutyrate dehydrogenase. In some embodiments, a polypeptide having the activity of an alcohol dehydrogenase classified under EC 1.1.1.258 is the gene product of chnD (e.g., an *Acinetobacter* sp. 6-hydroxyhexanoate dehydrogenase (see UniProtKB Accession No. Q7WVD0 (SEQ ID NO: 8))). See, for example, Iwaki et al., *Appl. Environ. Microbiol.*, 1999, supra. An alcohol dehydrogenase classified under EC 1.1.1.258 may also be referred to as a 6-hydroxyhexanoate dehydrogenase.

Other Enzymes Used in the Biosynthesis of $C_{2n+3}$ Building Blocks

In some embodiments, a polypeptide having the activity of a carboxylate reductase is classified, for example, under EC 1.2.99.6. In some embodiments, a polypeptide having the activity of a carboxylate reductase may be the gene product of car (e.g., a *Mycobacterium marinum* carboxylate reductase (see UniProtKB Accession No. B2HN69 (SEQ ID NO: 25) or a *Nocardia iowensis* carboxylate reductase (see UniProtKB Accession No. Q6RKB1 (SEQ ID NO: 26))). In some embodiments, a polypeptide having the activity of carboxylate reductase is the gene product of fadD9 (e.g., *Mycobacterium smegmatis* fatty-acid-CoA ligase (see UniProtKB Accession No. AOQWI7 (SEQ ID NO: 27)) or *Mycobacterium smegmatis* fatty-acid-CoA ligase (see UniProtKB Accession No. A0A0D6J1A6 (SEQ ID NO: 28))).

In some embodiments, a carboxylate reductase may be selected from: a *Mycobacterium smegmatis* carboxylate reductase (see UniProtKB Accession No. AOR484 (SEQ ID NO: 29)); a *Mycobacterium avium* carboxylate reductase (see GenBank Accession No. WP_019730046.1 (SEQ ID NO: 30)); a *Segniliparus rugosus* carboxylate reductase (see UniProtKB Accession No. E5XUS9 (SEQ ID NO: 31)); a *Mycobacterium* sp. JS623 carboxylate reductase (see UniProtKB Accession No. L0IYJ8 (SEQ ID NO: 32)); a *Mycobacterium heckeshornense* carboxylate reductase (see UniProtKB Accession No. A0A0J8X8T4 (SEQ ID NO: 33)); a *Mycobacterium goodii* carboxylate reductase (see UniProtKB Accession No. A0A0K0XCM7 (SEQ ID NO: 34)); a *Mycobacterium goodii* carboxylate reductase (see UniProtKB Accession No. A0A0K0X557 (SEQ ID NO: 35)); a *Mycobacterium intracellulare* carboxylate reductase (see UniProtKB Accession No. H8ITF4 (SEQ ID NO: 36)); a *Mycobacterium massiliense* carboxylate reductase (see Genbank Accession No. EIV11143.1 (SEQ ID NO: 37)); a *Segniliparus rotundus* carboxylate reductase (see Genbank Accession No. D6Z860 (SEQ ID NO: 38)); and a *Segniliparus rotundus* carboxylate reductase (see UniProtKB Accession No. D6ZDT1 (SEQ ID NO: 39)).

In some embodiments, a carboxylate reductase may be selected from: a *Mycobacterium smegmatis* carboxylate reductase (see UniProtKB Accession No. AOR484 (SEQ ID NO: 29)); a *Mycobacterium avium* carboxylate reductase (see GenBank Accession No. WP_019730046.1 (SEQ ID NO: 30)); and a *Segniliparus rugosus* carboxylate reductase (see UniProtKB Accession No. E5XUS9 (SEQ ID NO: 31)).

In some embodiments, a carboxylate reductase may be selected from: a *Mycobacterium* sp. JS623 carboxylate reductase (see UniProtKB Accession No. LOIYJ8 (SEQ ID NO: 32)); a *Mycobacterium heckeshornense* carboxylate reductase (see UniProtKB Accession No. A0A0J8X8T4 (SEQ ID NO: 33)); a *Mycobacterium goodii* carboxylate reductase (see UniProtKB Accession No. A0A0K0XCM7 (SEQ ID NO: 34)); a *Mycobacterium goodii* carboxylate reductase (see UniProtKB Accession No. A0A0K0X557 (SEQ ID NO: 35)); a *Mycobacterium intracellulare* carboxylate reductase (see UniProtKB Accession No. H8ITF4 (SEQ ID NO: 36)); and a *Mycobacterium smegmatis* fatty-acid-CoA ligase (see UniProtKB Accession No. A0A0D6J1A6 (SEQ ID NO: 28)).

In some embodiment, a carboxylate reductase may be selected from a: *Chromera velia* CCMP2878 carboxylate reductase (see UniProtKB Accession No. A0A0G4ID64 (SEQ ID NO: 196)); *Cyberlindnera jadinii* (Torula yeast) (*Pichia jadinii*) carboxylate reductase (see UniProtKB Accession No. A0A0H5CAG1 (SEQ ID NO: 197)); *Pestalotiopsis fici* W106-1 carboxylate reductase (see UniProtKB Accession No. W3XHR4 (SEQ ID NO: 198)); *Caenorhabditis elegans* carboxylate reductase (see UniProtKB Accession No. Q18660 (SEQ ID NO: 199)); *Tetrahymena thermophila* (strain SB210) carboxylate reductase (see UniProtKB Accession No. I7MB41 (SEQ ID NO: 200)); *Auxenochlorella protothecoides* (Green microalga) (*Chlorella protothecoides*) carboxylate reductase (see UniProtKB Accession No. A0A087SHC7 (SEQ ID NO: 201)); *Lichtheimia corymbifera* JMRC:FSU.:9682 carboxylate reductase (see UniProtKB Accession No. A0A068SDQ8 (SEQ ID NO: 202)); *Labilithrix luteola* carboxylate reductase (see UniProtKB Accession No. A0A0K1PNT5 (SEQ ID NO: 203)); *Geotrichum candidum* (*Oospora lactis*) (*Dipodascus geotrichum*) carboxylate reductase (see UniProtKB Accession No. A0A0J9XGX9 (SEQ ID NO: 204)); *Kuraishia capsulata* CBS 1993 carboxylate reductase (see UniProtKB Accession No. W6MHS7 (SEQ ID NO: 205)); *Phytophthora sojae* (strain P6497) (Soybean stem and root rot agent) (*Phytophthora megasperma* f sp. glycines) carboxylate reductase (see UniProtKB Accession No. G4YTV4 (SEQ ID NO: 206)); *Dictyostelium discoideum* (Slime mold) carboxylate reductase (see UniProtKB Accession No. Q1ZXQ4 (SEQ ID NO: 207)); *Ascaris suum* (Pig roundworm) (*Ascaris lumbricoides*) carboxylate reductase (see UniProtKB Accession No. F1KXI1 (SEQ ID NO: 208)); *Nocardia brasiliensis* NBRC 14402 carboxylate reductase (see UniProtKB Accession No. A0A034UK40 (SEQ ID NO: 209)); *Rhizopus microspores* carboxylate reductase (see UniProtKB Accession No. A0A0C7BIS0 (SEQ ID NO: 210)); *Theileria parva* (East coast fever infection agent) carboxylate reductase (see UniProtKB Accession No. Q4N8F1 (SEQ ID NO: 211)); *Anisakis simplex* (Herring worm) carboxylate reductase (see UniProtKB Accession No. A0A0M3J210 (SEQ ID NO: 212)); *Helobdella robusta* (Californian leech) carboxylate reductase (see UniProtKB Accession No. T1EG09 (SEQ ID NO: 213)); *Mycobacterium lepromatosis* carboxylate reductase (see UniProtKB Accession No. A0A0F4ES51 (SEQ ID NO: 214)); and *Schizopora paradoxa* carboxylate reductase (see UniProtKB Accession No. A0A0H2RRC5 (SEQ ID NO: 215)).

In some embodiments, a polypeptide having the activity of an N-acetyltransferase (e.g., a lysine N-acetyltransferase) is classified, for example, under EC 2.3.1.32. See, for example, Paik et al., *Arch Biochem Biophys.*, 1964 November, 108: 221-29. An N-acetyltransferase classified under EC 2.3.1.32 may be the gene product of LYC1 (e.g., *Yarrowia lipolytica* lysine N-acetyltransferase (see UniProtKB Accession No. P41929 (SEQ ID NO: 53))).

In some embodiments, a polypeptide having the activity of a phosphopantetheine transferase is classified, for example, under EC 2.7.8.-, such as EC 2.7.8.7. In some embodiments, a phosphopantetheine transferase classified under EC 2.7.8.-is the gene product of sfp (e.g., *Bacillus subtilis* phosphopantetheine transferase (see UniProtKB Accession No. P39135 (SEQ ID NO: 54)). In some embodiments, a phosphopantetheine transferase classified under EC 2.7.8.7 is the gene product of npt (e.g., *Nocardia* sp. NRRL 5646 phosphopantetheine transferase (see Genbank Accession No. ABI83656.1 (SEQ ID NO: 55))). In some embodiments, a phosphopantetheine transferase may be the gene products of griC and griD from *Streptomyces griseus* (UniProtKB Accession No. Q9ZN75 (SEQ ID NO: 56) and UniProtKB Accession No. Q9ZN74 (SEQ ID NO: 57)). See, for example, Suzuki et al., *J. Antibiot.*, 2007, 60(6), 380-387.

Enzymes Attenuated to Improve Biosynthesis of $C_{2n+3}$ Building Blocks

One or more of the following enzymes may be attenuated in a recombinant host described herein, such as, for example, a polyhydroxyalkanoate synthase, an acetyl-CoA thioesterase, an acetyl-CoA specific β-ketothiolase, a phosphotransacetylase forming acetate, an acetate kinase, a lactate dehydrogenase, a menaquinol-fumarate oxidoreductase, a 2-oxoacid decarboxylase producing isobutanol, an alcohol dehydrogenase forming ethanol, a triose phosphate isomerase, a pyruvate decarboxylase, a glucose-6-phosphate isomerase, a transhydrogenase dissipating the NADH or NADPH imbalance, an glutamate dehydrogenase dissipating the NADH or NADPH imbalance, a NADH/NADPH-utilizing glutamate dehydrogenase, a pimeloyl-CoA dehydrogenase; an acyl-CoA dehydrogenase accepting $C_5$, $C_7$, $C_9$, $C_{11}$, $C_{13}$, $C_{15}$, $C_{17}$, or $C_{19}$ building blocks and central precursors as substrates; a glutaryl-CoA dehydrogenase; or a pimeloyl-CoA synthetase.

In some embodiments, a polyhydroxyalkanoate synthase is attenuated, such as the gene product of phaC, from, for example *Rhodospirillum rubrum* (see UniProtKB Accession No. Q9RNU7 (SEQ ID NO: 141)). In some embodiments, a lactate dehydrogenase is attenuated, such as the gene product of IldhA (Shen et al., 2011, supra) or ldh, such as, for example, the gene product of ldh from *Geobacillus stearothermophilus* (see UniProtKB Accession No. P00344 (SEQ ID NO: 142)). In some embodiments, a menaquinol-fumarate oxidoreductase, such as the gene product of frdBC (see, e.g., Shen et al., 2011, supra), is attenuated.

In some embodiments, a triose phosphate isomerase classified, for example, under EC 5.3.1.1, is attenuated, such as, for example, the gene product of tpiA from, for example, *Escherichia coli* (see UniProtKB Accession No. P0A858 (SEQ ID NO: 143)). In some embodiments, a glucose-6-phosphate isomerase classified, for example, under EC 5.3.1.9, such as the gene product of GPI from, for example, *Homo sapiens* (see UniProtKB Accession No. P06744 (SEQ ID NO: 144)) is attenuated. In some embodiments, a glutamate dehydrogenase dissipating the NADH or NADPH imbalance classified, for example, under EC 1.4.1.2 (NADH-specific), EC 1.4.1.3, or EC 1.4.1.4 (NADPH-specific) is attenuated. In some embodiments, an NADH/NADPH-utilizing glutamate dehydrogenase classified, for example, under EC 1.4.1.3 is attenuated, such as, for example an NADH/NADPH-utilizing glutamate dehydrogenase from *Homo sapiens* (see UniProtKB Accession No. P00367 (SEQ ID NO: 145)) or *Bos Taurus* (see UniProtKB Accession No. P00366 (SEQ ID NO: 146)).

In some embodiments, a pimeloyl-CoA dehydrogenase classified, for example, under EC 1.3.1.62, such as the gene product of pimD from, for example, Aromatoleum *aromaticum* (see UniProtKB Accession No. Q5P017 (SEQ ID NO: 147)) is attenuated. In some embodiments, an acyl-CoA dehydrogenase accepting $C_5$, $C_7$, $C_9$, $C_{11}$, $C_{13}$, $C_{15}$, $C_{17}$, or $C_{19}$ building blocks and central precursors as substrates classified, for example, under EC 1.3.8.1, EC 1.3.8.7, EC 1.3.8.8, or EC 1.3.8.9 is attenuated, such as, for example, an acyl-CoA dehydrogenase from *Rattus norvegicus* (see UniProtKB Accession No. P08503 (SEQ ID NO: 148)).

In some embodiments, a glutaryl-CoA dehydrogenase classified, for example, under EC 1.3.8.6 is attenuated, such as a glutaryl-CoA dehydrogenase from Kibdelosporangium sp. MJ126-NF4 (see UniProtKB Accession No. A0A0K3B4X3 (SEQ ID NO: 149)). In some embodiments, a pimeloyl-CoA synthetase classified, for example, under EC 6.2.1.14 is attenuated, such as the gene product of BIO1 from, for example, *Saccharomyces cerevisiae* (see UniProtKB Accession No. E9P9F6 (SEQ ID NO: 150)).

Generic Biochemical Pathways

Figure 9:
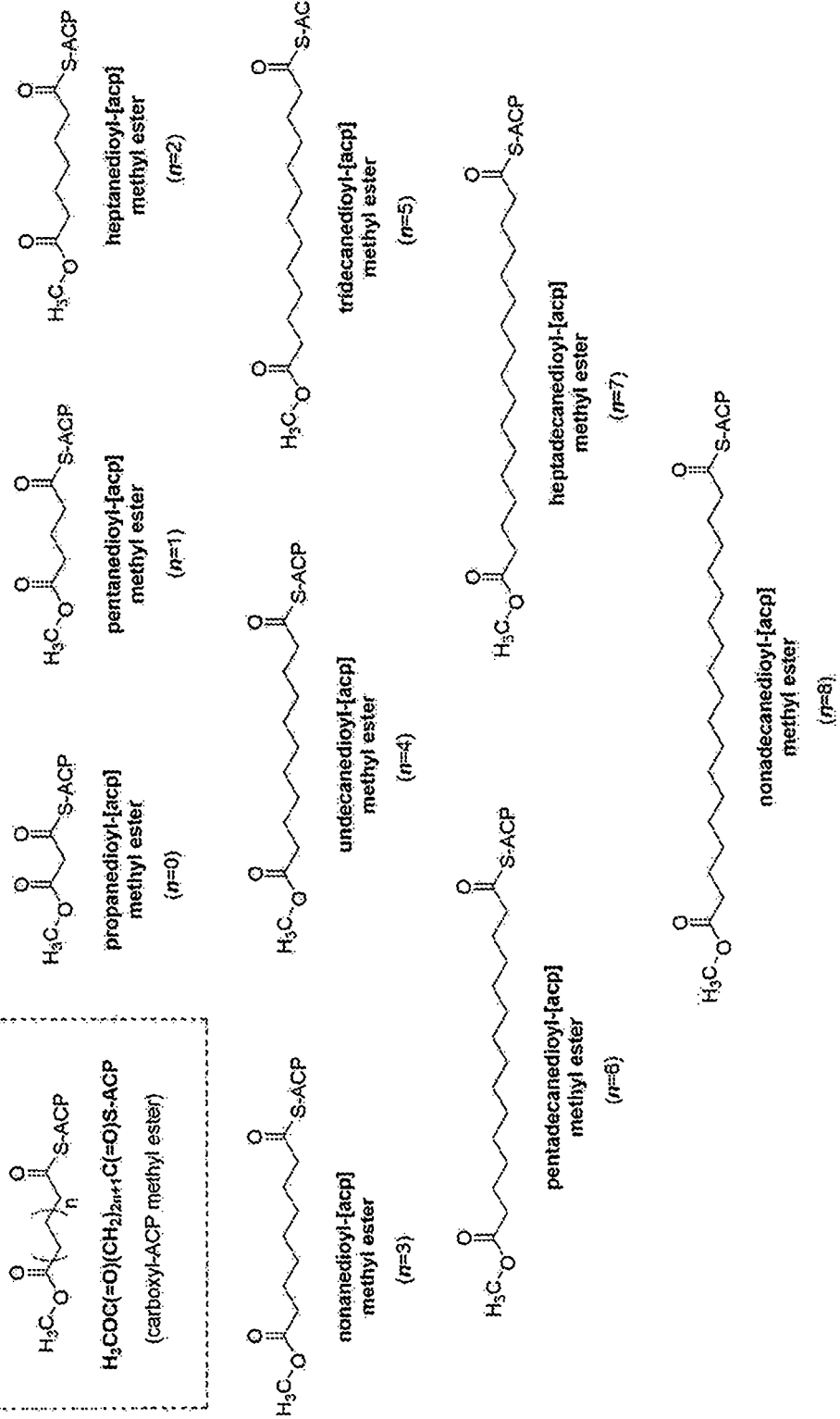
FIG. 9 illustrates the structures of carboxyl-ACP methyl esters produced by n cycles of methyl ester shielded carbon chain elongation for n=0, 1, 2, 3, 4, 5, 6, 7, and 8.
Figure 10:
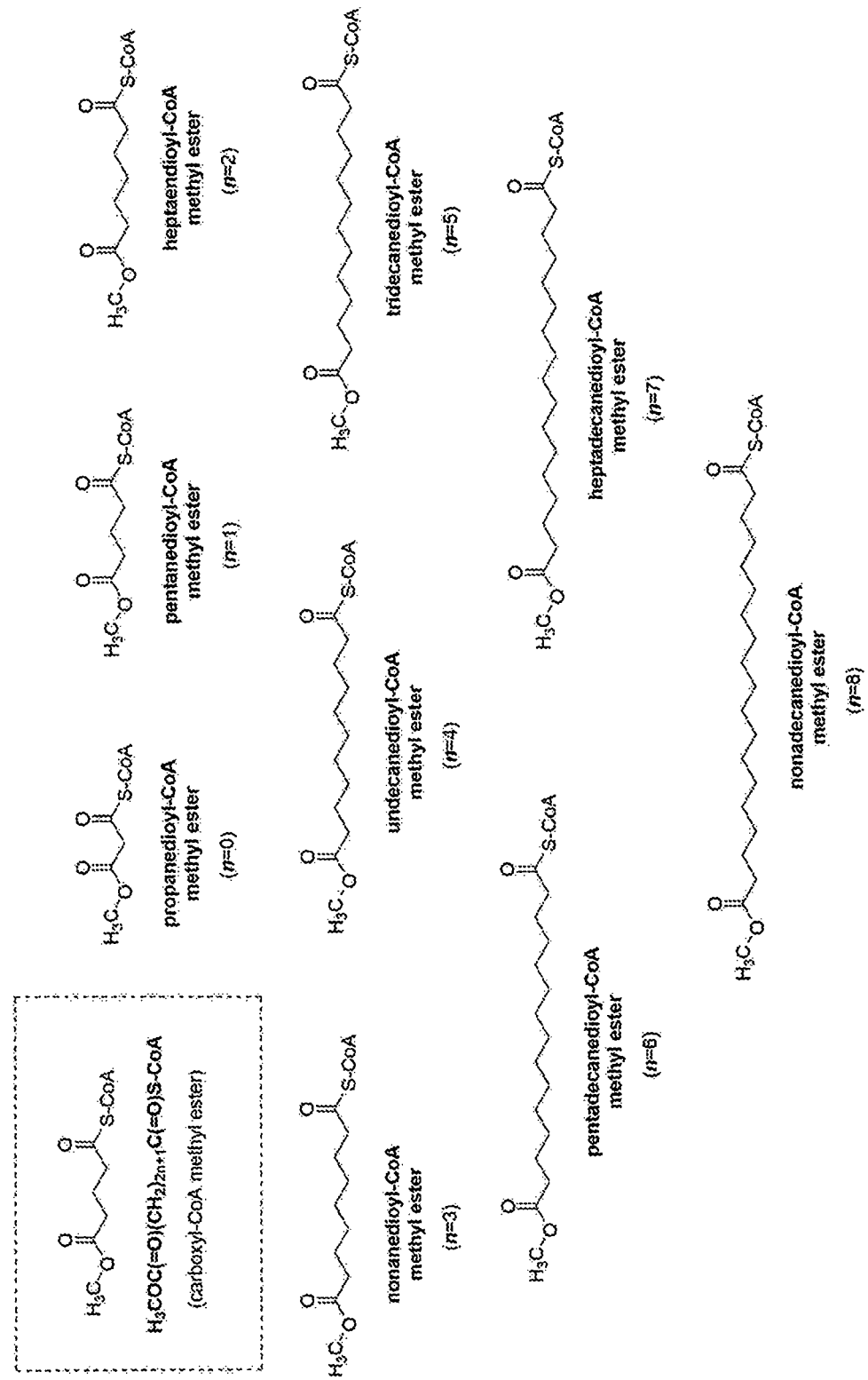
FIG. 10 illustrates the structures of carboxyl-CoA methyl esters produced by n cycles of methyl ester shielded carbon chain elongation for n=0, 1, 2, 3, 4, 5, 6, 7, and 8.

The generic biochemical pathways described herein are illustrated in FIGS. 1-8. In all figures, n is an integer greater than or equal to one, such as, for example, one, two, three, four, five, six, seven, or eight. The integer n corresponds to the number of methyl ester shielded carbon chain elongation cycles used to synthesize an aliphatic carbon chain backbone having an odd number of carbon atoms from (i) acetyl-CoA and propanedioyl-CoA or (ii) propanedioyl-[acp]. For example, the aliphatic carbon chain backbone resulting from n cycles of methyl ester shielded carbon chain elongation will have (2n+3) carbon atoms. See Table 1. Table 1 lists the $C_{2n+3}$ aliphatic carbon chain backbones produced using the methods below after n cycles of methyl ester shielded carbon chain elongation for n is 1, 2, 3, 4, 5, 6, 7, or 8. Chemical structures for the $C_{2n+3}$ aliphatic carbon chain backbones (i.e., carboxyl-[acp] methyl esters and carboxyl-CoA methyl esters) of varying carbon chain length are illustrated in FIGS. 9 and 10.

TABLE 1

| | $C_{2n+3}$ Aliphatic Backbones | |
|---|---|---|
| n | $H_3COC(=O)(CH_2)_{2n+1}C(=O)S$—ACP (carboxyl-ACP methyl ester) | $H_3COC(=O)(CH_2)2_{n+1}C(=O)S$—CoA (carboxyl-CoA methyl ester) |
| 1 | pentanedioyl-[acp] methyl ester | pentanedioyl-CoA methyl ester |
| 2 | heptanedioyl-[acp] methyl ester | heptanedioyl-CoA methyl ester |
| 3 | nonanedioyl-[acp] methyl ester | nonanedioyl-CoA methyl ester |
| 4 | undecanedioyl-[acp] methyl ester | undecanedioyl-CoA methyl ester |
| 5 | tridecanedioyl-[acp] methyl ester | tridecanedioyl-CoA methyl ester |
| 6 | pentadecanedioyl-[acp] methyl ester | pentadecanedioyl-CoA methyl ester |
| 7 | heptadecanedioyl-[acp] methyl ester | heptadecanedioyl-CoA methyl ester |
| 8 | nonadecanedioyl-[acp] methyl ester | nonadecanedioyl-CoA methyl ester |

Figure 11:
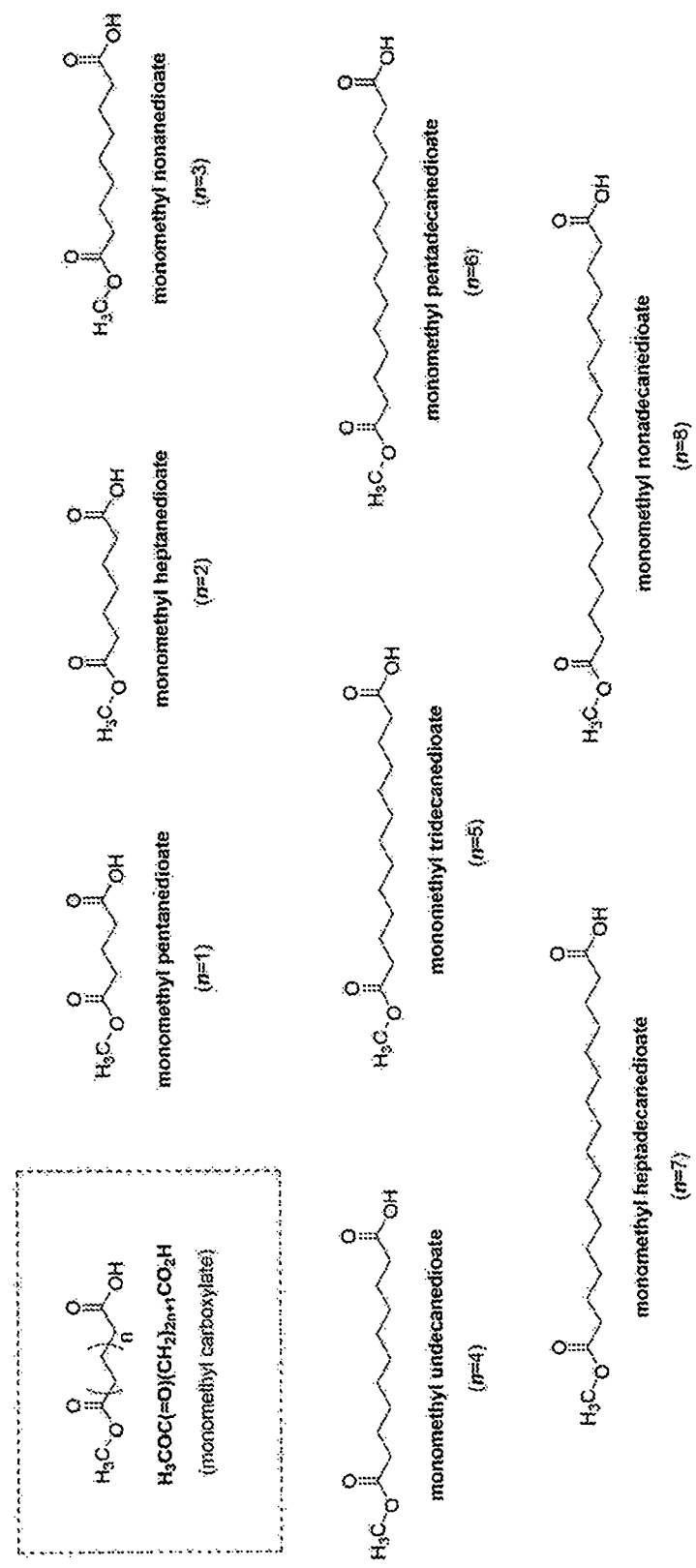
FIG. 11 illustrates the structures of monomethyl carboxylates produced from aliphatic backbones having an odd number of carbon atoms following n cycles of methyl ester shielded carbon chain elongation, where n is 1, 2, 3, 4, 5, 6, 7, or 8.
Figure 12:
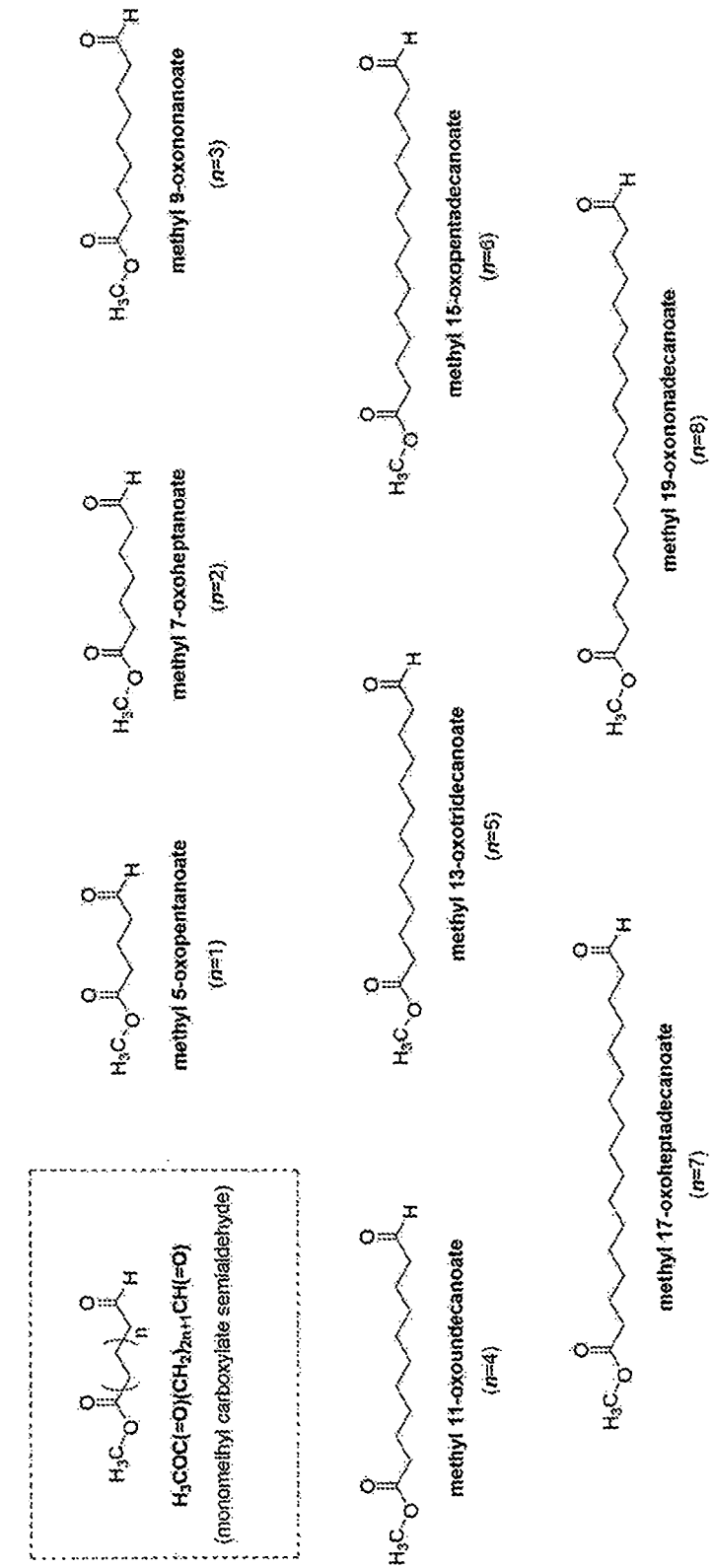
FIG. 12 illustrates the structures of monomethyl carboxylate semialdehydes produced from aliphatic backbones having an odd number of carbon atoms following n cycles of methyl ester shielded carbon chain elongation, where n is 1, 2, 3, 4, 5, 6, 7, or 8.

Tables 2A, 2B, and 2C list intermediate compounds synthesized in the production of $C_{2n+3}$ building blocks from a $C_{2n+3}$ aliphatic backbone produced from (i) acetyl-CoA and propanedioyl-CoA via n cycles of methyl ester shielded carbon chain elongation or (ii) propanedioyl-[acp] via n cycles of methyl ester shielded carbon chain elongation, wherein n is 1, 2, 3, 4, 5, 6, 7, or 8. The chemical structures for intermediate compounds of varying carbon chain lengths are illustrated in FIG. 11 (monomethyl carboxylates), 12 (monomethyl carboxylate semialdehydes), 14 (monomethyl aminocarboxylates), 17 (aminoaldehydes), 20 (hydroxyamines), 21 (acetamidocarboxylates), 22, (acetamidoaldehydes), 23 (acetamidoamines), 24 (dials), 25 (hydroxyaldehydes).

In addition, FIG. 27 (3-oxo-carboxyl-ACP methyl esters), 28 (3-oxo-carboxyl-CoA methyl esters), 29 (3-hydroxy-carboxyl-ACP methyl esters), 30 (3-hydroxy-carboxyl-CoA methyl esters), 31 (2,3-dehydrocarboxyl-ACP methyl esters), and 32 (2,3-dehydrocarboxyl-ACP methyl esters) illustrate the structures of intermediates produced during methyl ester shielded carbon chain elongation cycles.

Figure 13:
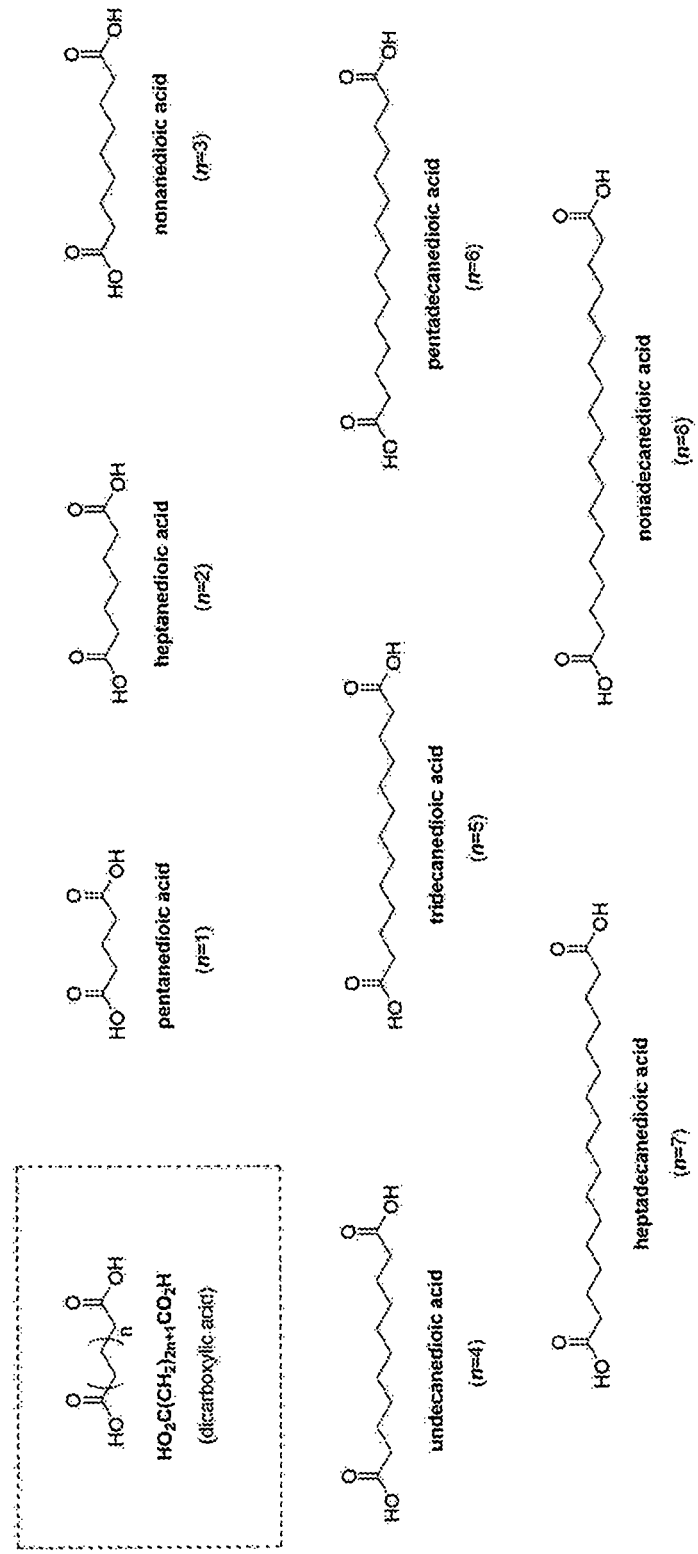
FIG. 13 illustrates the structures of dicarboxylic acids produced from aliphatic backbones having an odd number of carbon atoms following n cycles of methyl ester shielded carbon chain elongation, where n is 1, 2, 3, 4, 5, 6, 7, or 8.
Figure 14:
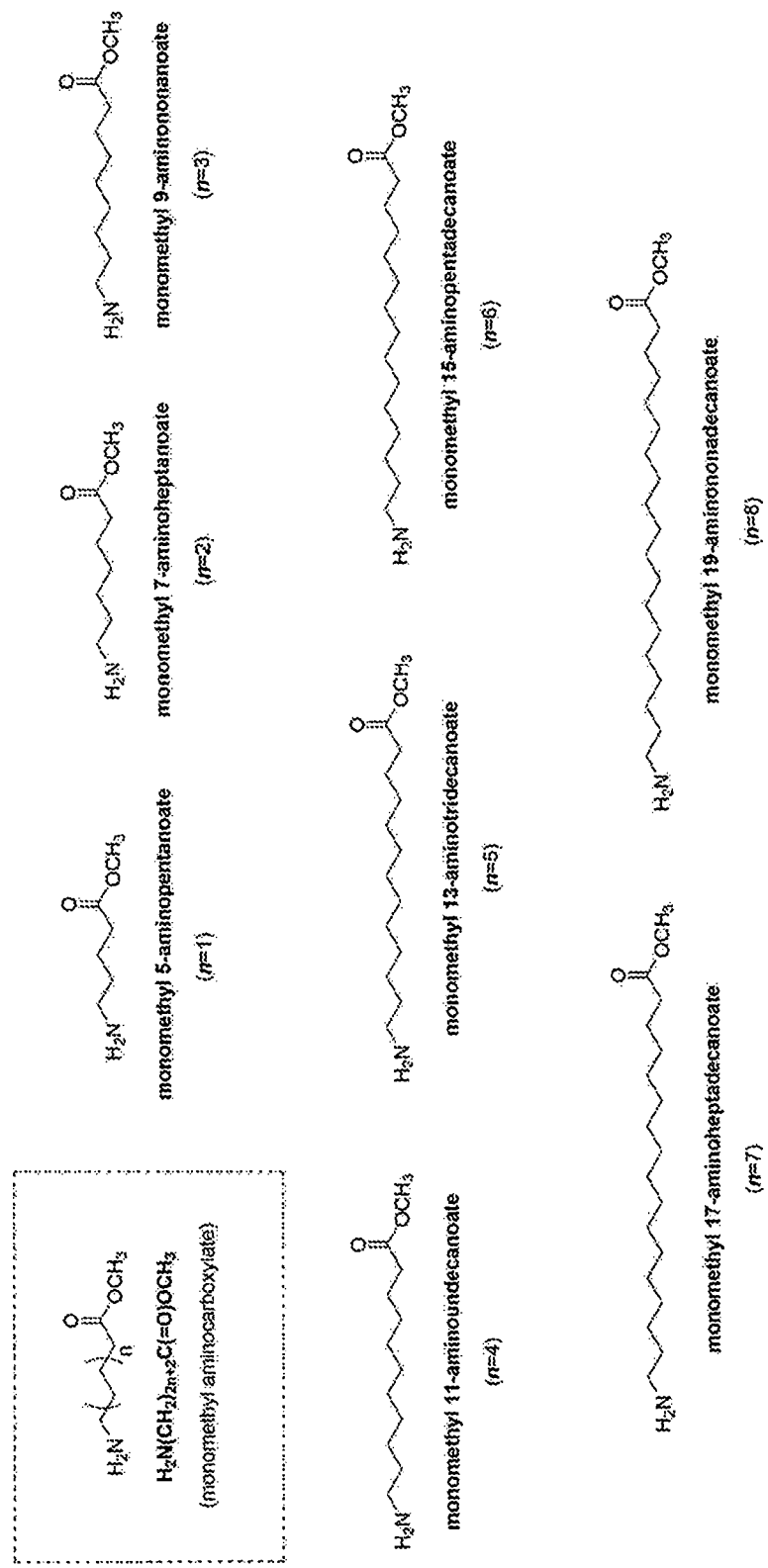
FIG. 14 illustrates the structures of monomethyl aminocarboxylates produced from aliphatic backbones having an odd number of carbon atoms following n cycles of methyl ester shielded carbon chain elongation, where n is 1, 2, 3, 4, 5, 6, 7, or 8.
Figure 15:
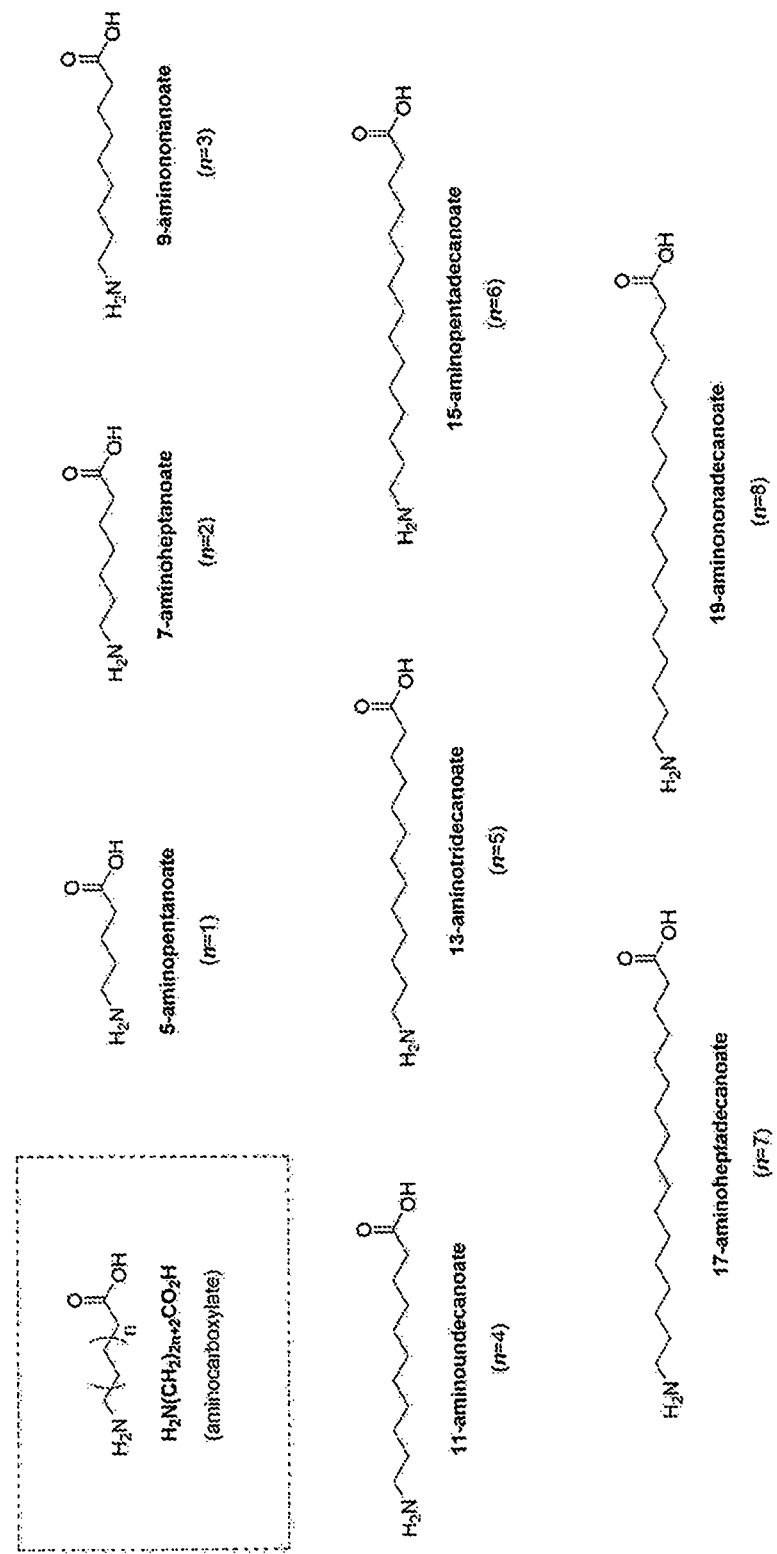
FIG. 15 illustrates the structures of aminocarboxylates produced from aliphatic backbones having an odd number of carbon atoms following n cycles of methyl ester shielded carbon chain elongation, where n is 1, 2, 3, 4, 5, 6, 7, or 8.
Figure 16:
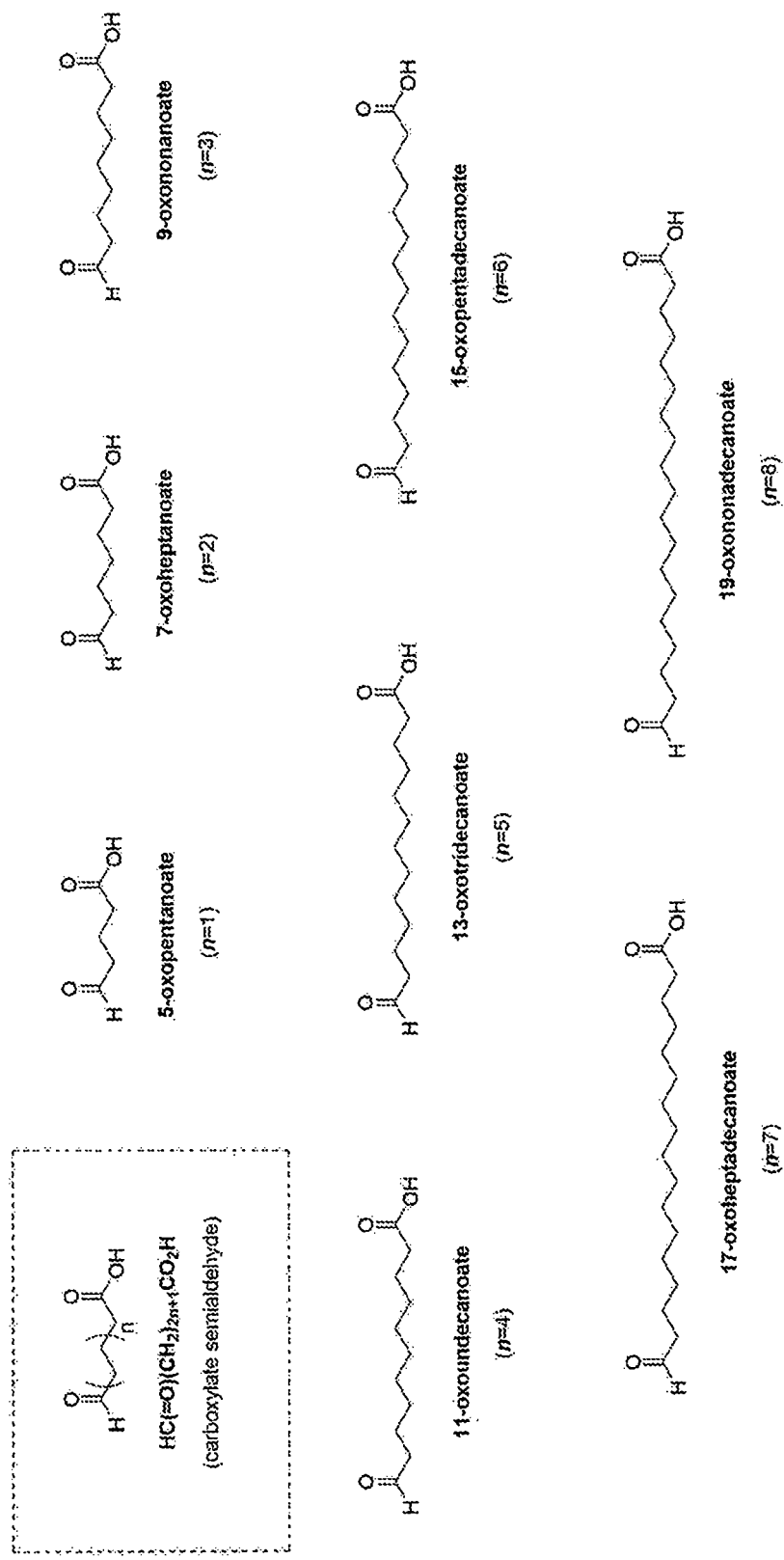
FIG. 16 illustrates the structures of carboxylate semialdehydes produced from aliphatic backbones having an odd number of carbon atoms following n cycles of methyl ester shielded carbon chain elongation, where n is 1, 2, 3, 4, 5, 6, 7, or 8.
Figure 17:
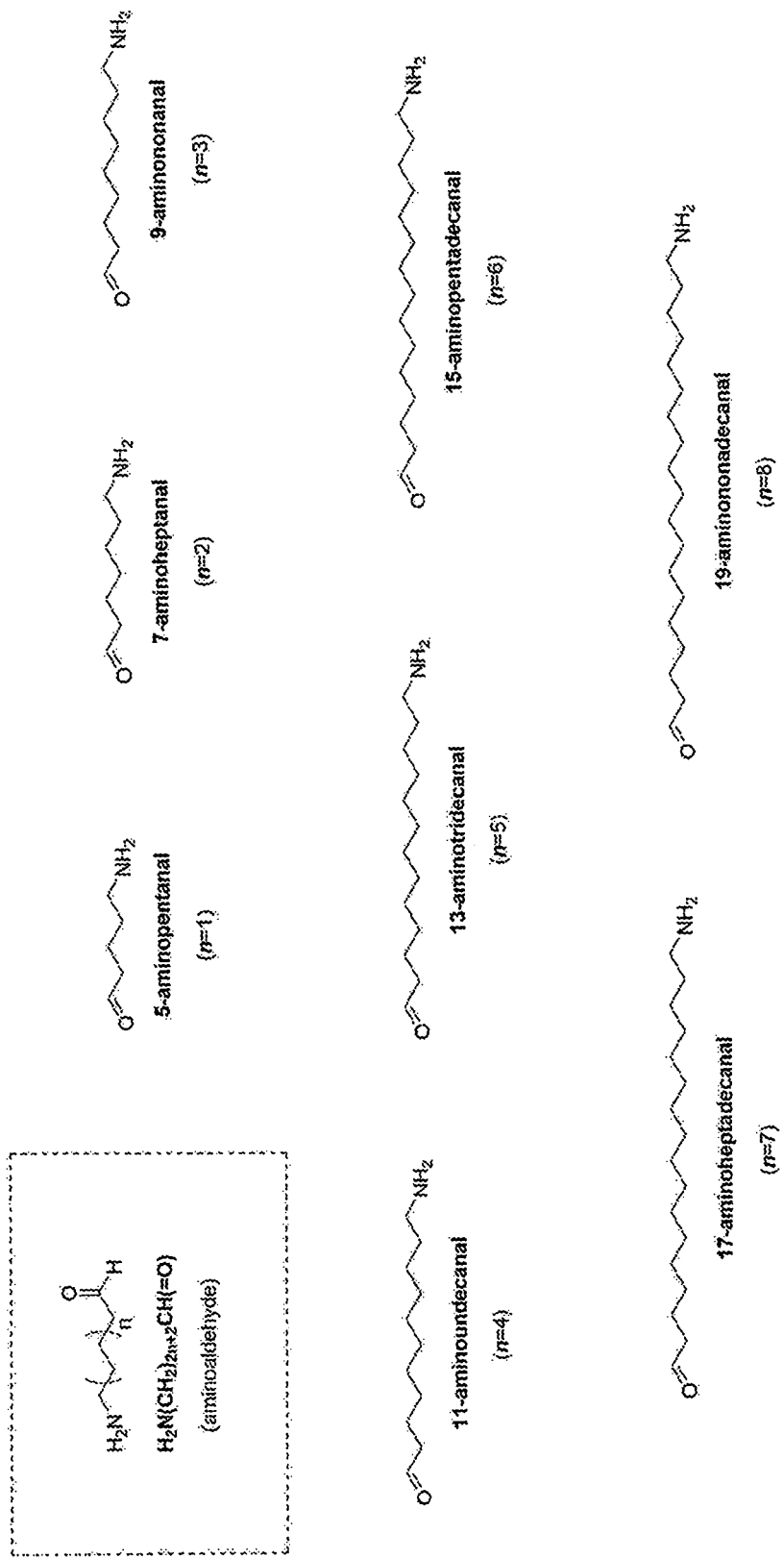
FIG. 17 illustrates the structures of aminoaldehydes produced from aliphatic backbones having an odd number of carbon atoms following n cycles of methyl ester shielded carbon chain elongation, where n is 1, 2, 3, 4, 5, 6, 7, or 8.
Figure 18:
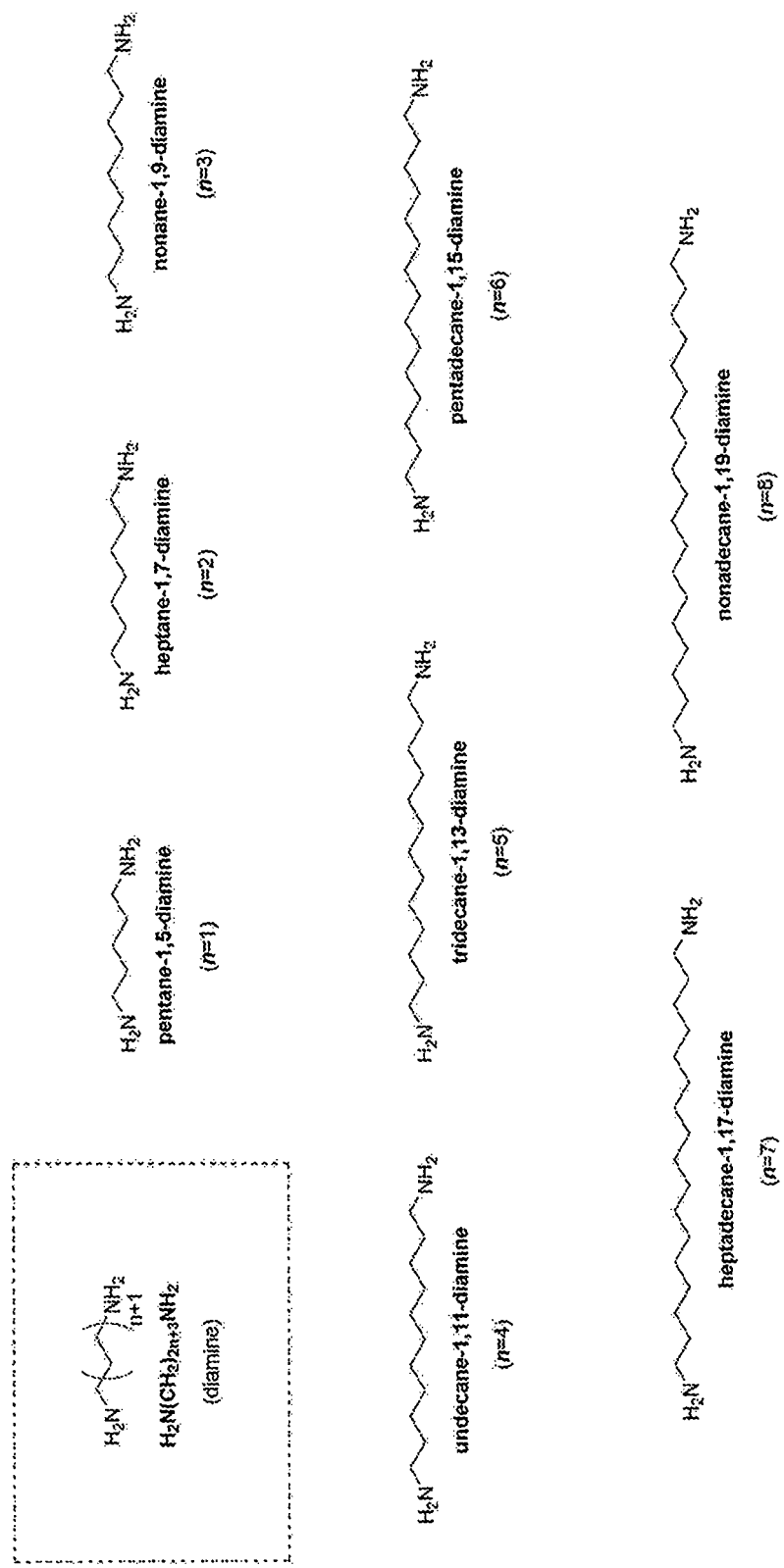
FIG. 18 illustrates the structures of diamines produced from aliphatic backbones having an odd number of carbon atoms following n cycles of methyl ester shielded carbon chain elongation, where n is 1, 2, 3, 4, 5, 6, 7, or 8.
Figure 19:
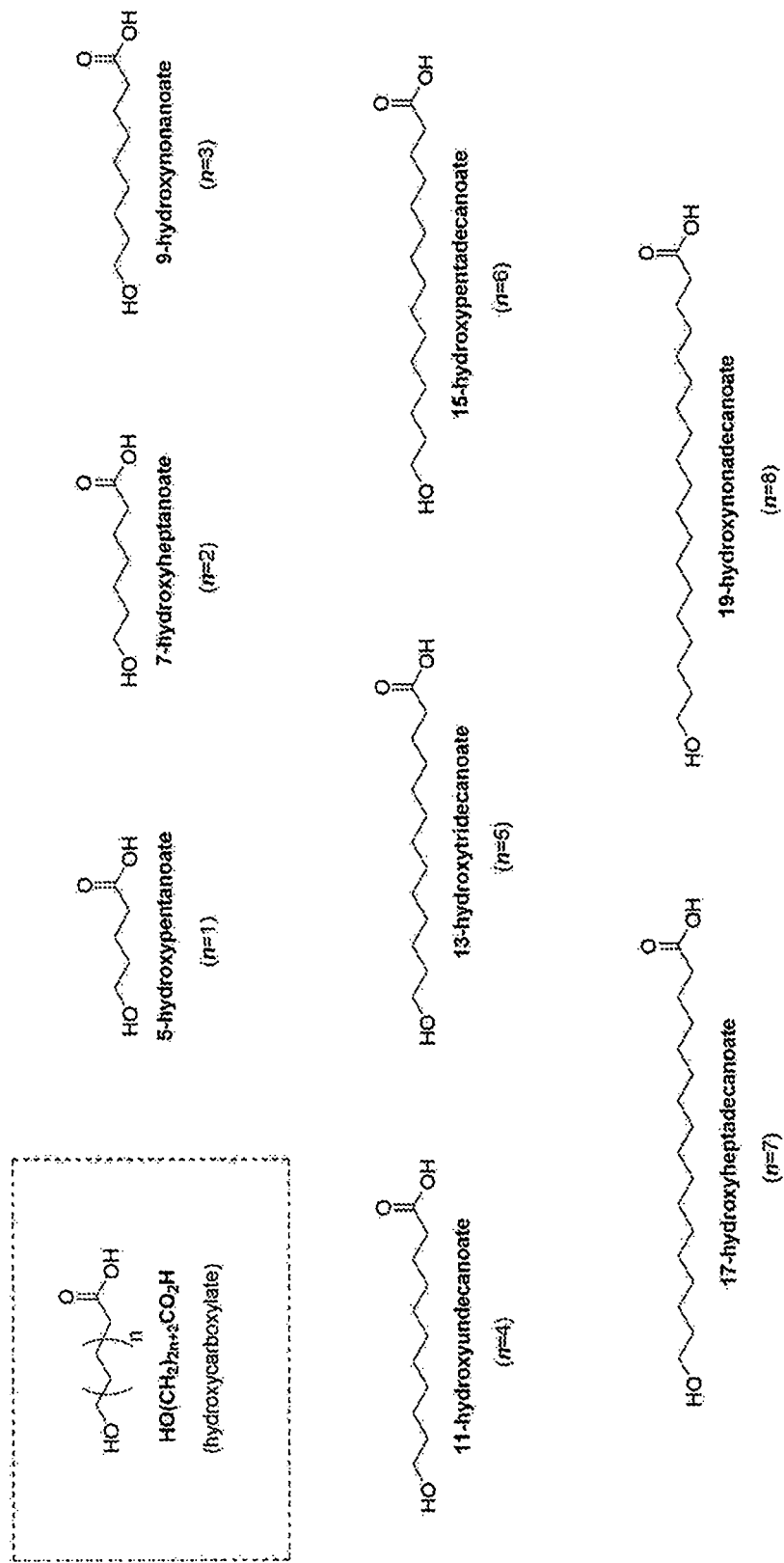
FIG. 19 illustrates the structures of hydroxycarboxylates produced from aliphatic backbones having an odd number of carbon atoms following n cycles of methyl ester shielded carbon chain elongation, where n is 1, 2, 3, 4, 5, 6, 7, or 8.
Figure 20:
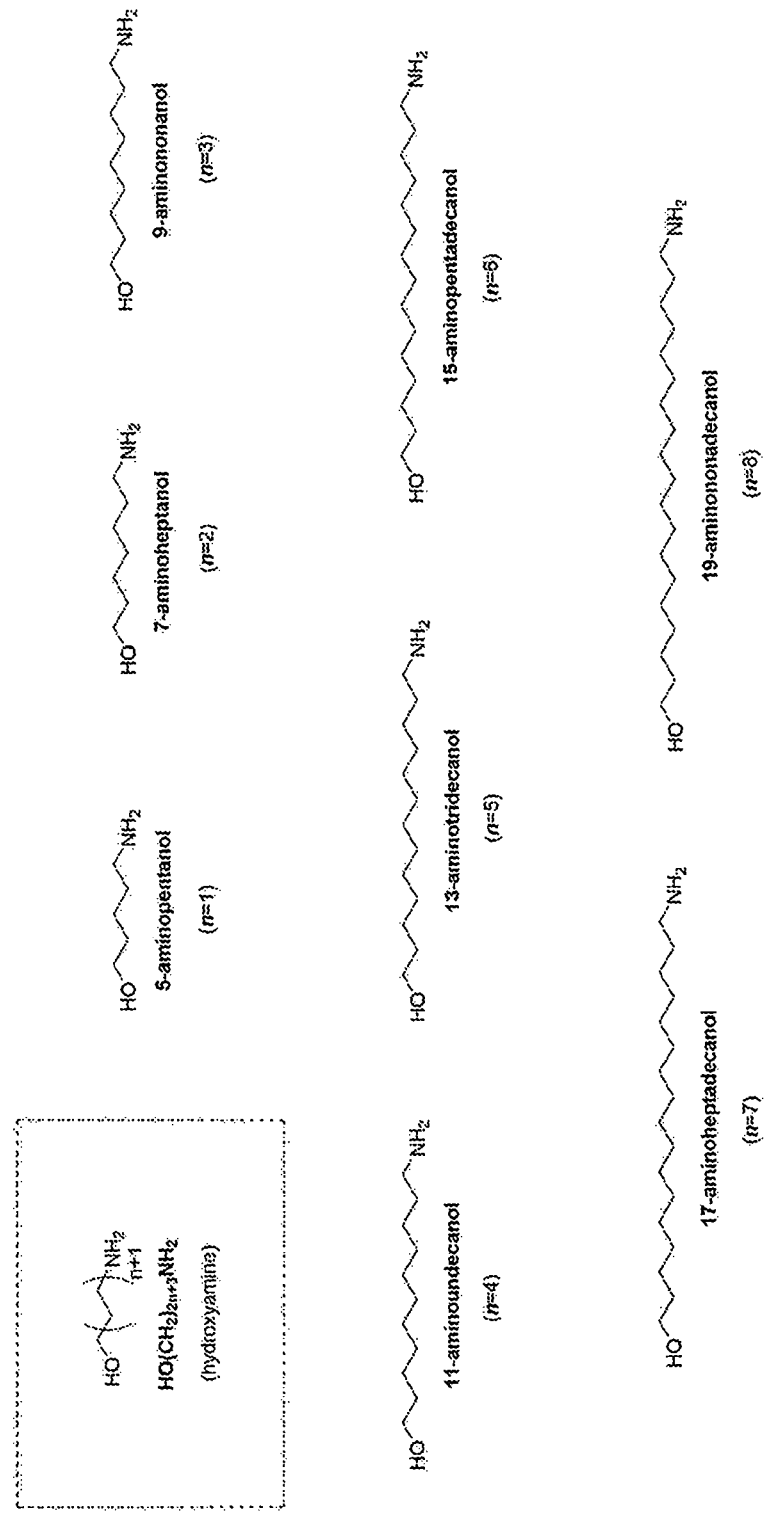
FIG. 20 illustrates the structures of hydroxyamines produced from aliphatic backbones having an odd number of carbon atoms following n cycles of methyl ester shielded carbon chain elongation, where n is 1, 2, 3, 4, 5, 6, 7, or 8.
Figure 22:
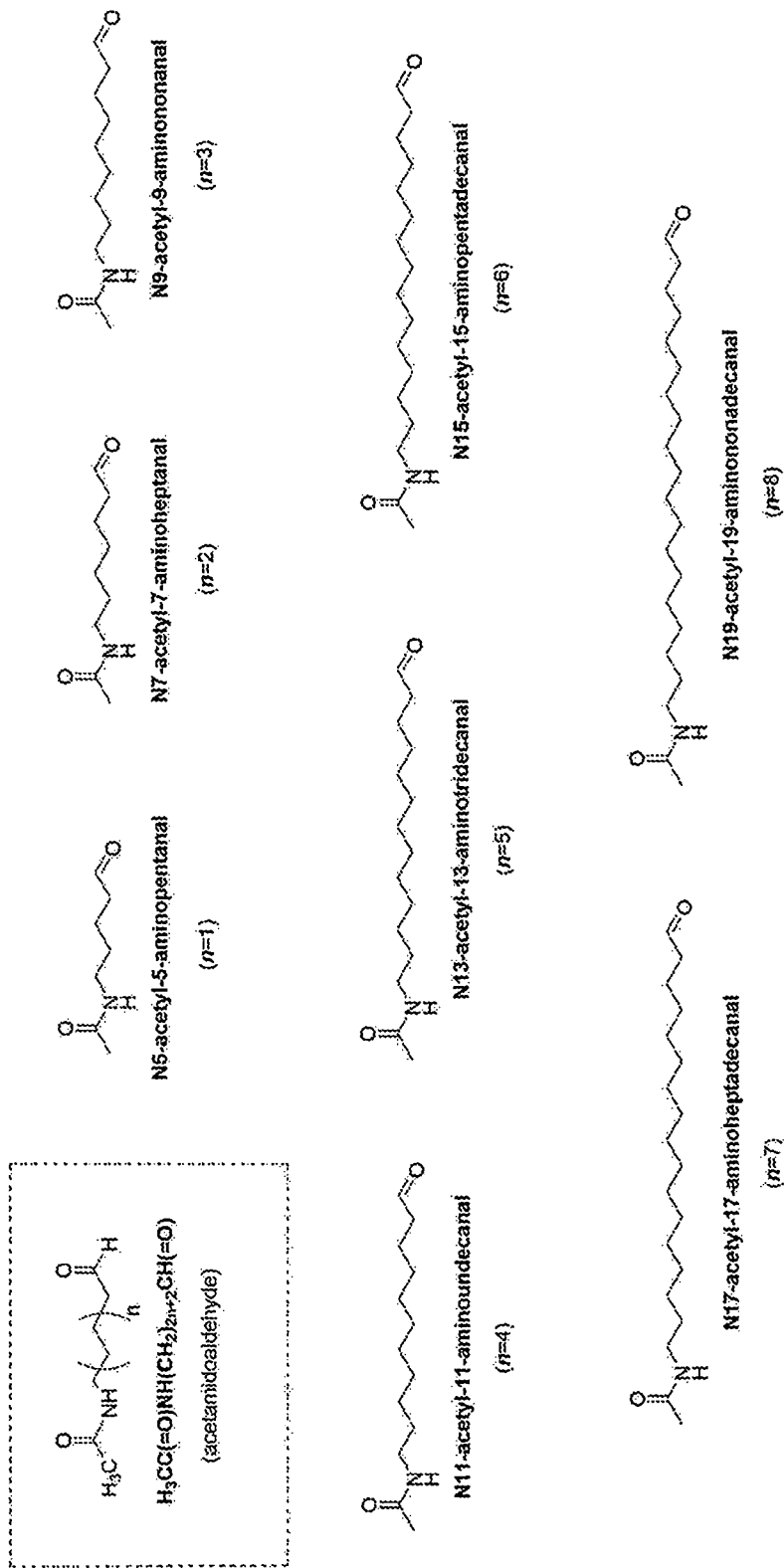
FIG. 22 illustrates the structures of acetamidoaldehydes produced from aliphatic backbones having an odd number of carbon atoms following n cycles of methyl ester shielded carbon chain elongation, where n is 1, 2, 3, 4, 5, 6, 7, or 8.
Figure 23:
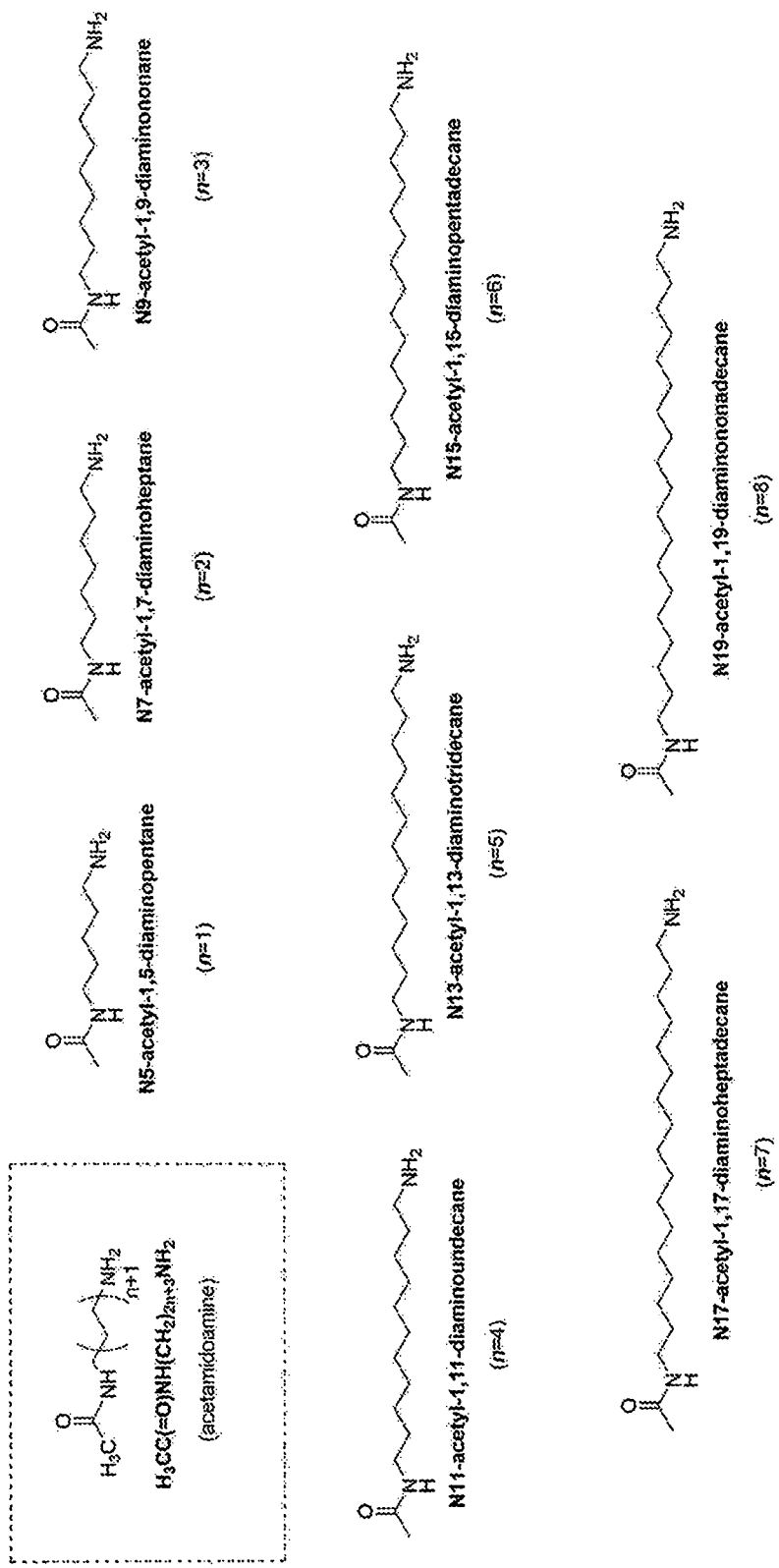
FIG. 23 illustrates the structures of acetamidoamines produced from aliphatic backbones having an odd number of carbon atoms following n cycles of methyl ester shielded carbon chain elongation, where n is 1, 2, 3, 4, 5, 6, 7, or 8.
Figure 24:
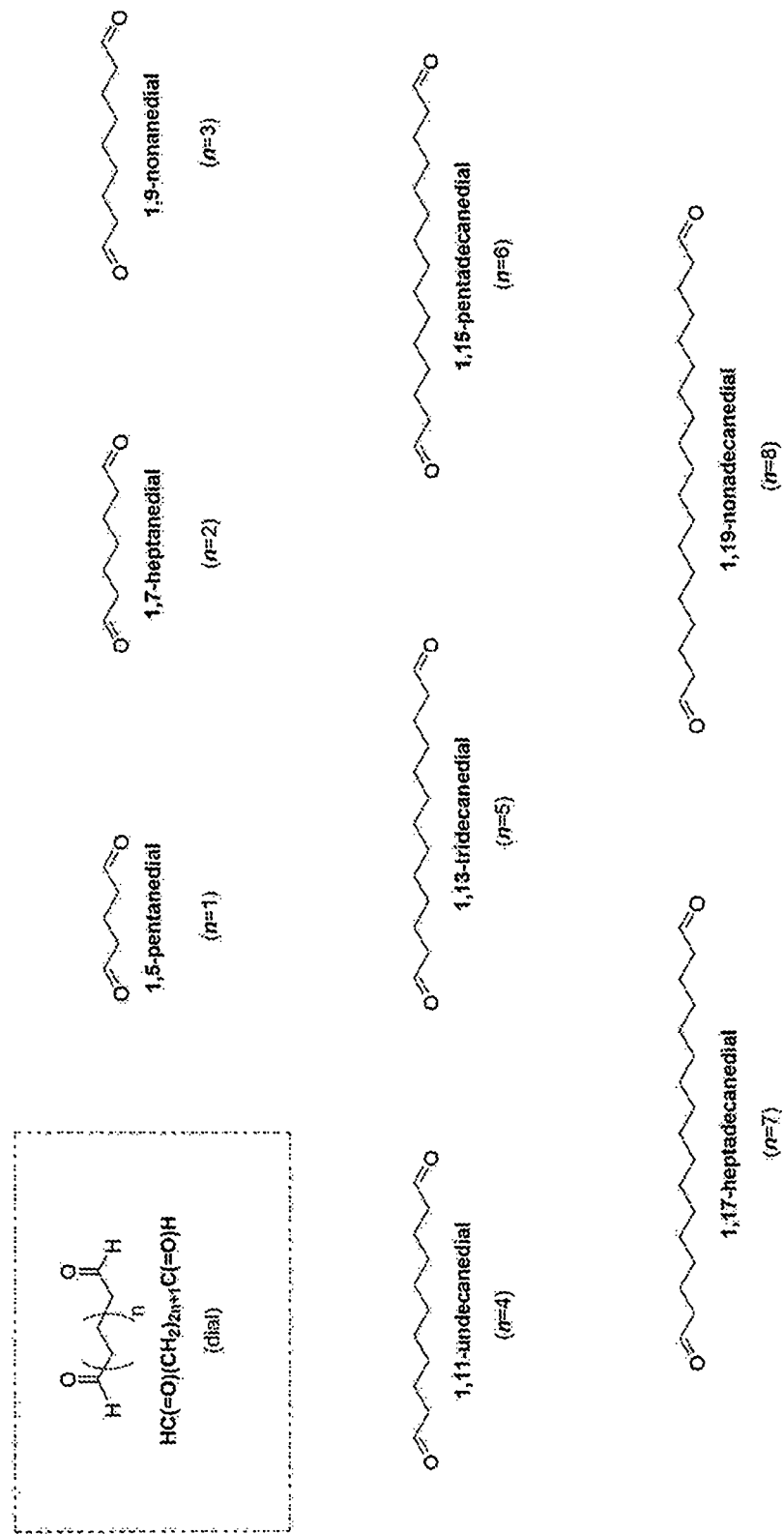
FIG. 24 illustrates the structures of dials produced from aliphatic backbones having an odd number of carbon atoms following n cycles of methyl ester shielded carbon chain elongation, where n is 1, 2, 3, 4, 5, 6, 7, or 8.
Figure 25:
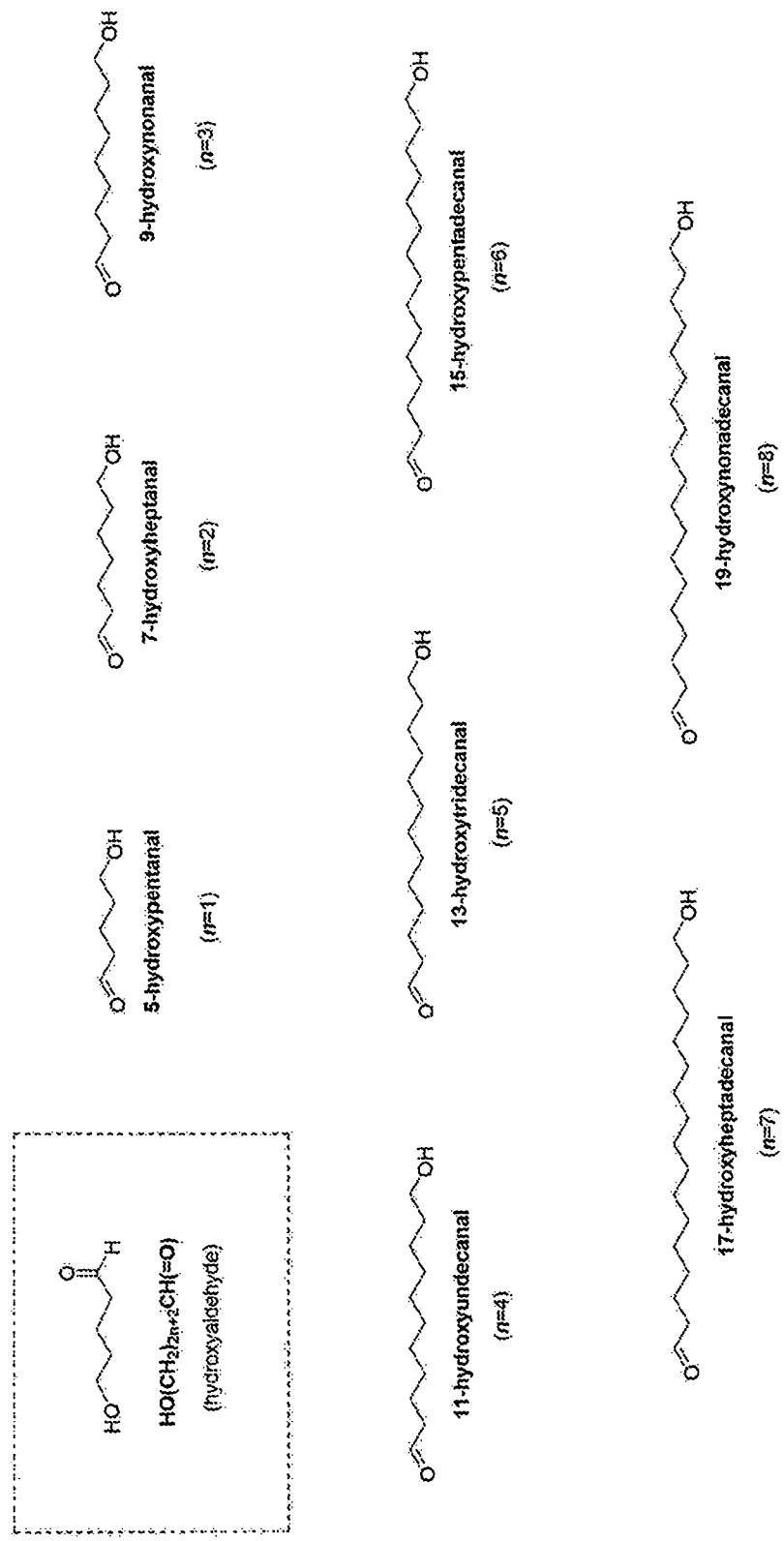
FIG. 25 illustrates the structures of hydroxyaldehydes produced from aliphatic backbones having an odd number of carbon atoms following n cycles of methyl ester shielded carbon chain elongation, where n is 1, 2, 3, 4, 5, 6, 7, or 8.
Figure 26:
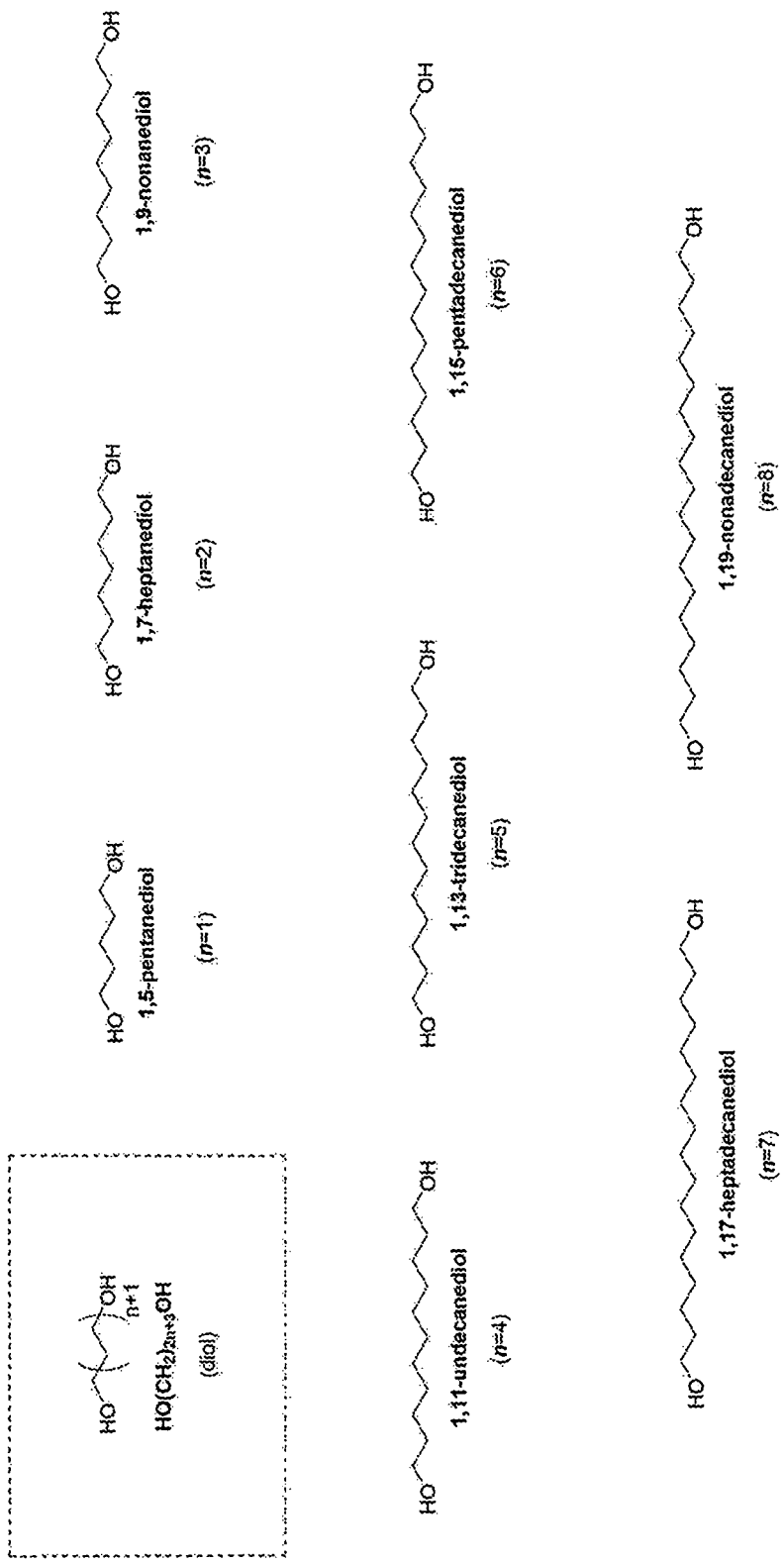
FIG. 26 illustrates the structures of diols produced from aliphatic backbones having an odd number of carbon atoms following n cycles of methyl ester shielded carbon chain elongation, where n is 1, 2, 3, 4, 5, 6, 7, or 8.
Figure 28:
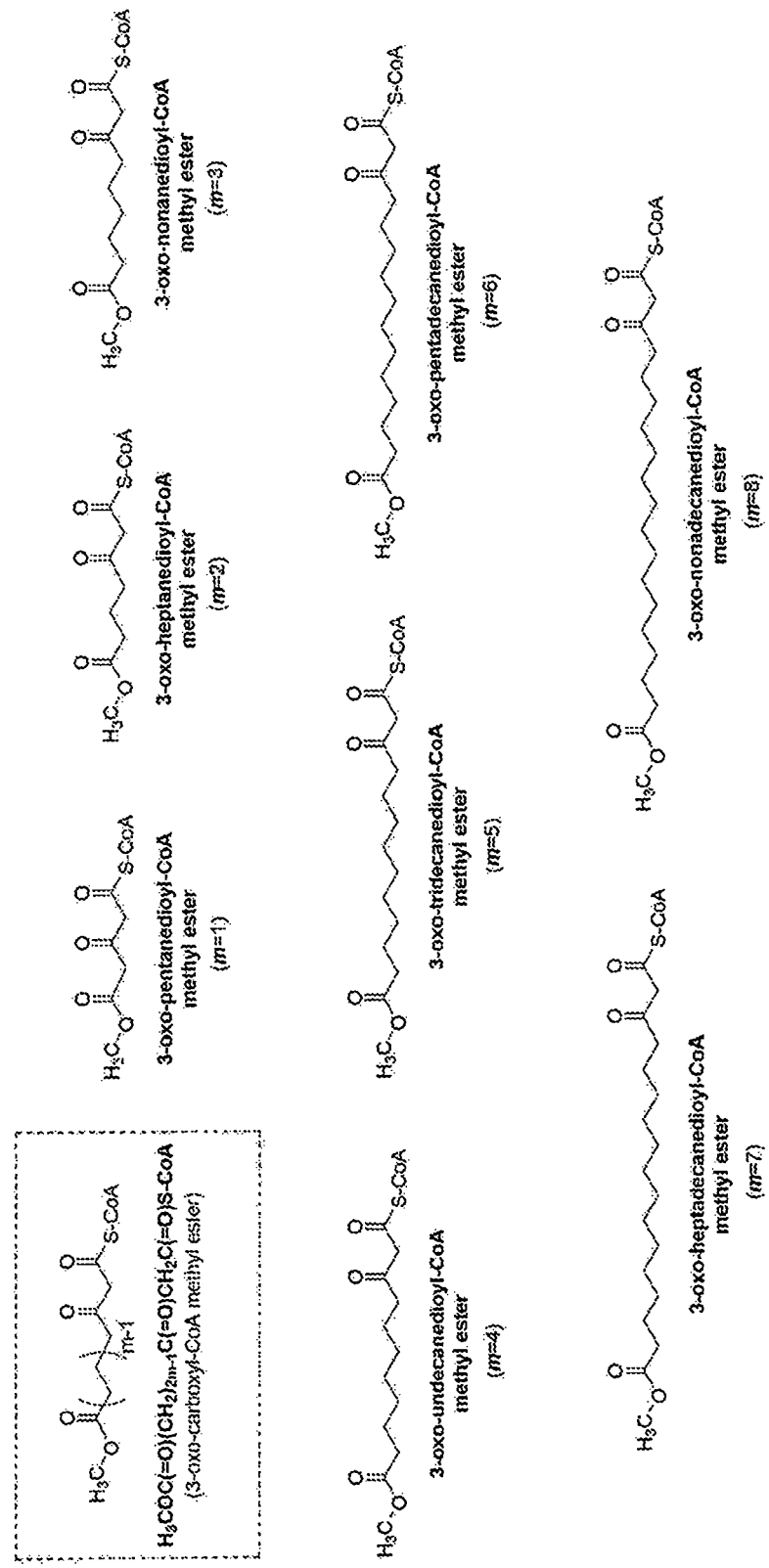
FIG. 28 illustrates the structures of 3-oxo-carboxyl-CoA methyl esters produced during the $m^{th}$ cycle of methyl shielded carbon chain elongation, where m is 1, 2, 3, 4, 5, 6, 7, or 8.
Figure 29:
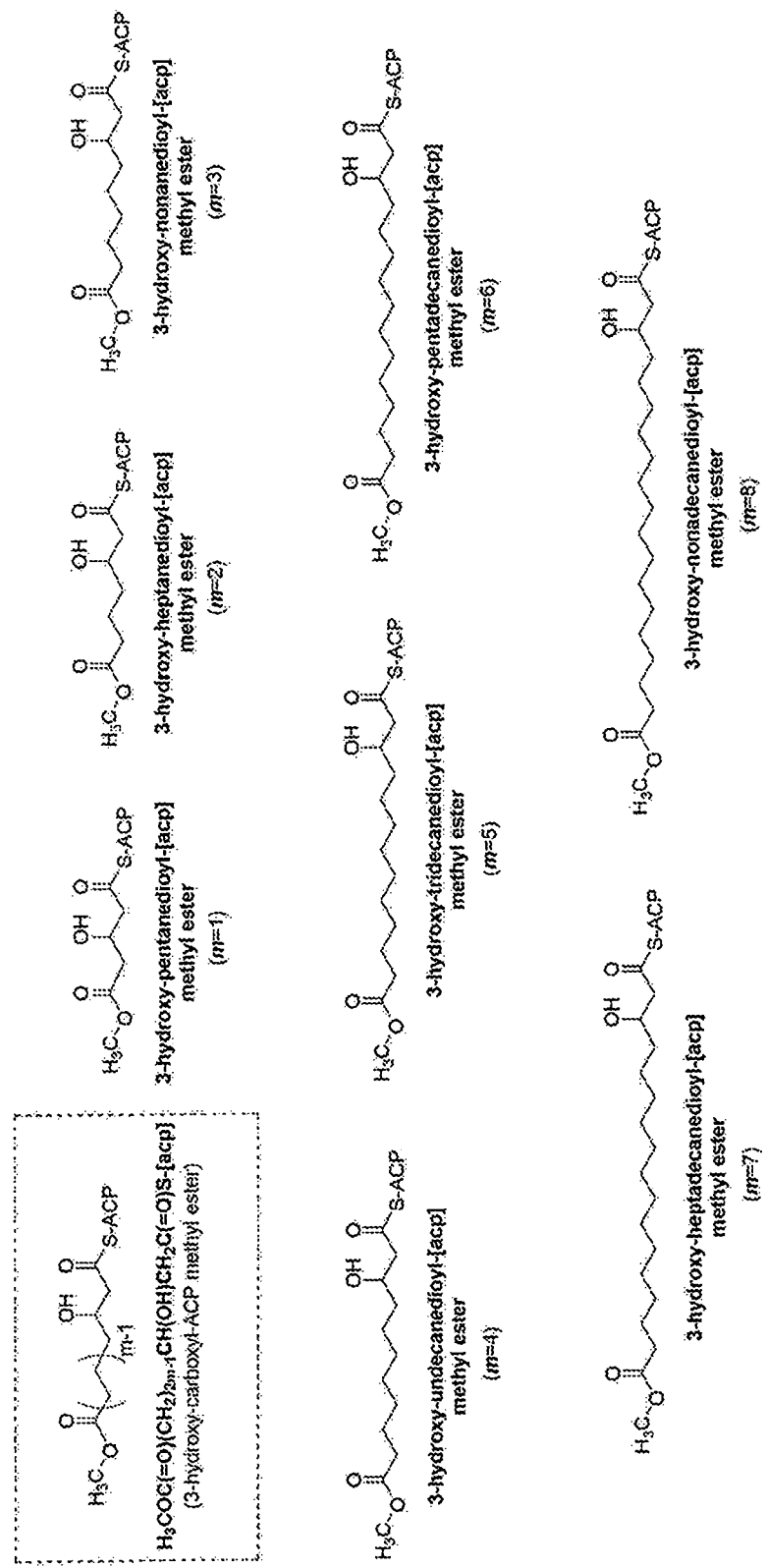
FIG. 29 illustrates the structures of 3-hydroxy-carboxyl-ACP methyl esters produced during the $m^{th}$ cycle of methyl shielded carbon chain elongation, where m is 1, 2, 3, 4, 5, 6, 7, or 8.
Figure 30:
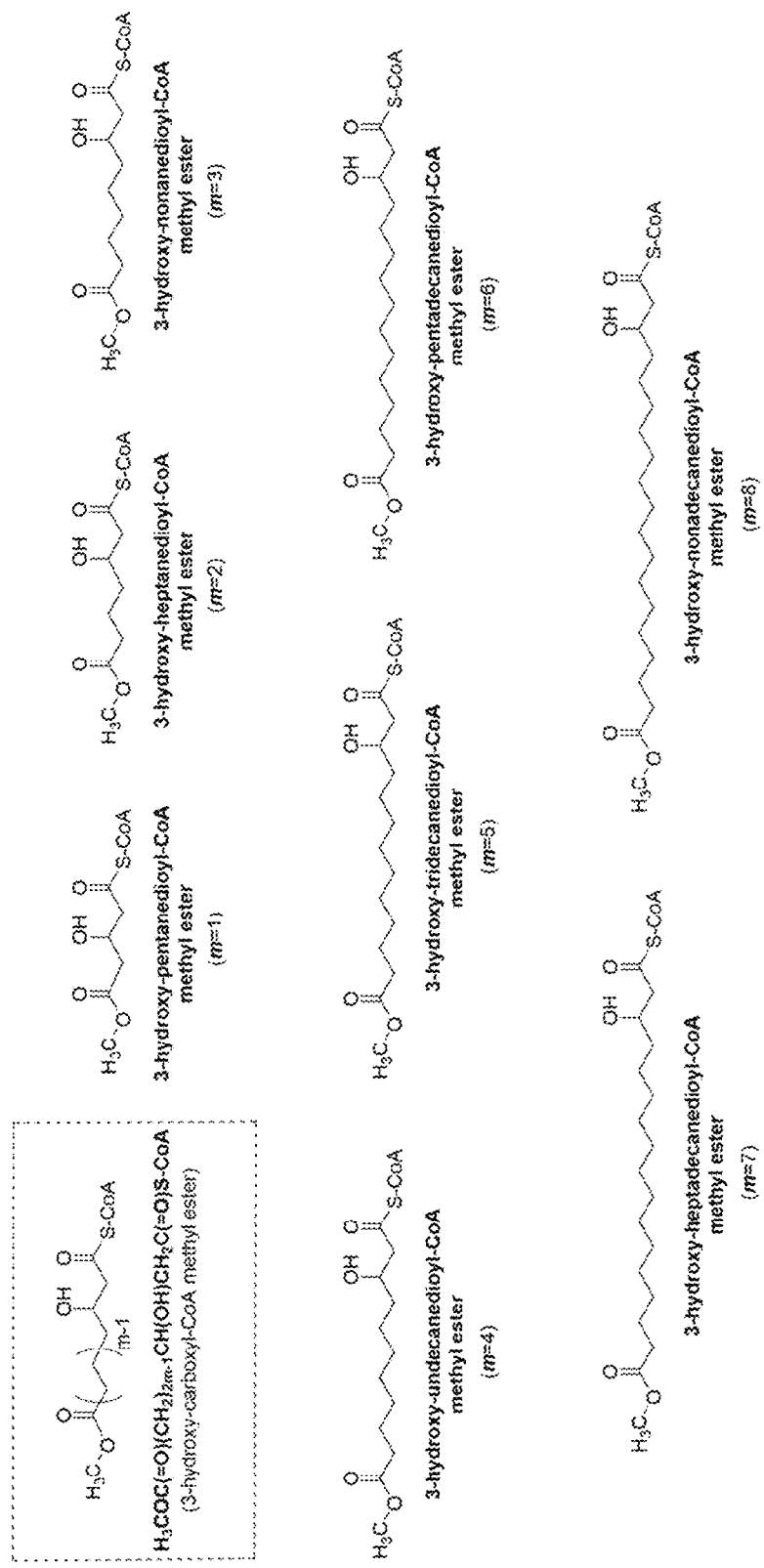
FIG. 30 illustrates the structures of 3-hydroxy-carboxyl-CoA methyl esters produced during the $m^{th}$ cycle of methyl shielded carbon chain elongation, where m is 1, 2, 3, 4, 5, 6, 7, or 8.
Figure 31:
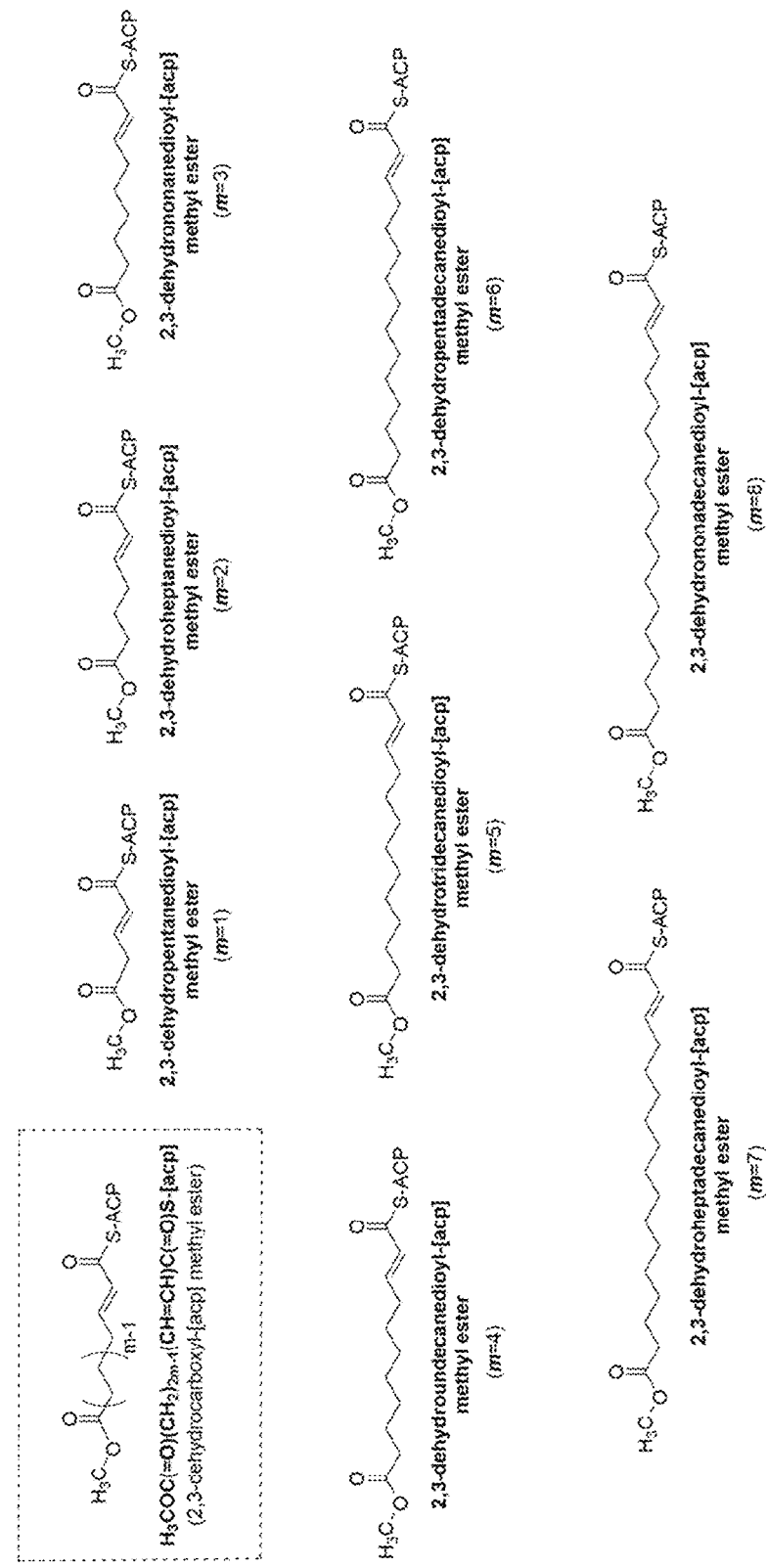
FIG. 31 illustrates the structures of 2,3-dehydrocarboxyl-ACP methyl esters produced during the $m^{th}$ cycle of methyl shielded carbon chain elongation, where m is 1, 2, 3, 4, 5, 6, 7, or 8.
Figure 32:
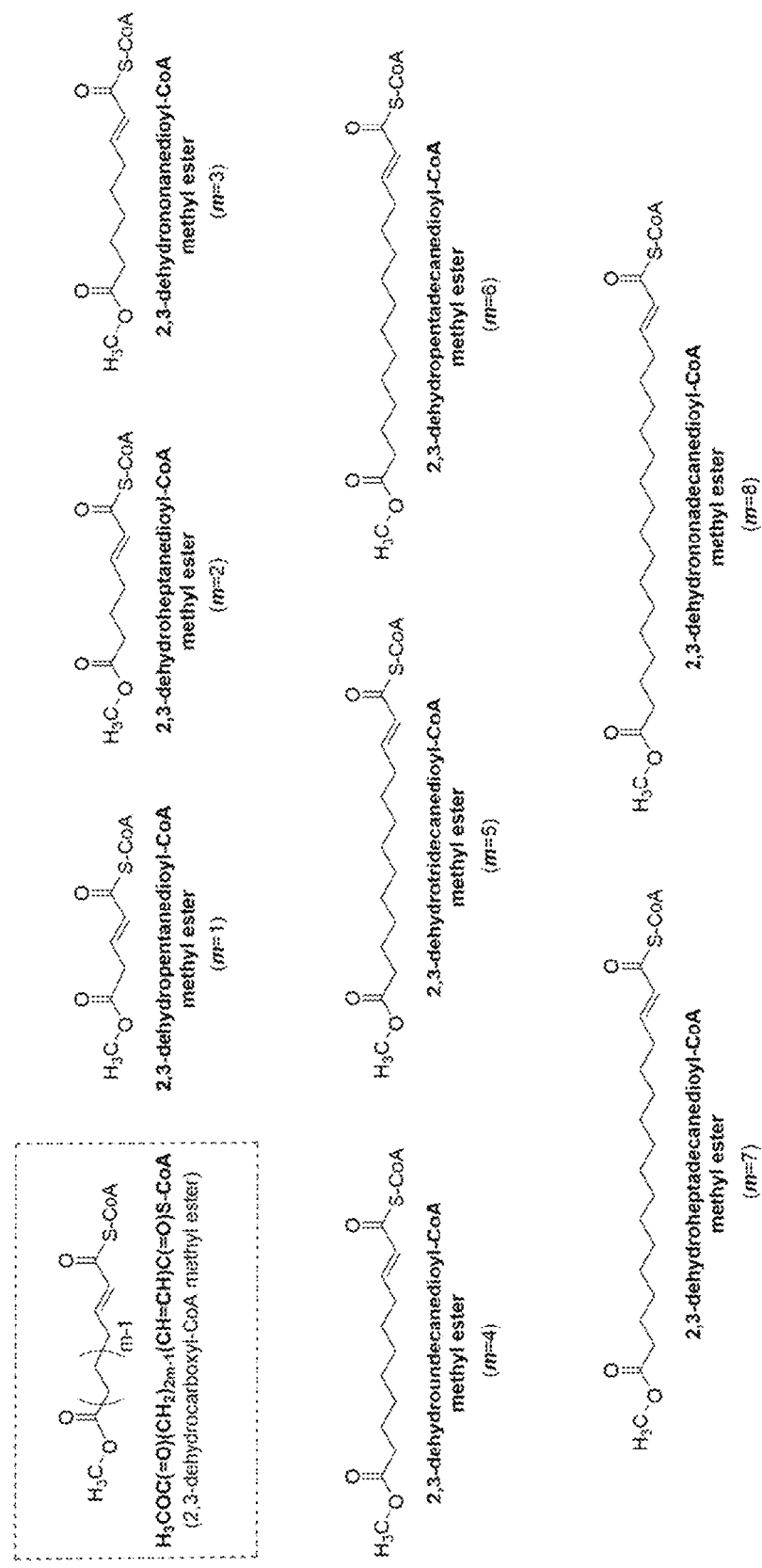
FIG. 32 illustrates the structures of 2,3-dehydrocarboxyl-CoA methyl esters produced during the $m^{th}$ cycle of methyl shielded carbon chain elongation, where m is 1, 2, 3, 4, 5, 6, 7, or 8.

Tables 3A and 3B list $C_{2n+3}$ building blocks, which are difunctional products having an odd number of carbon atoms, synthesized by the enzymatic conversion of a $C_{2n+3}$ aliphatic backbone produced from (i) acetyl-CoA and propanedioyl-CoA via n cycles of methyl ester shielded carbon chain elongation or (ii) propanedioyl-[acp] via n cycles of methyl ester shielded carbon chain elongation, wherein n is 1, 2, 3, 4, 5, 6, 7, or 8. The chemical structures for $C_{2n+3}$ building blocks of varying carbon chain length (e.g., $C_5$, $C_7$, $C_9$, $C_{11}$, $C_{13}$, $C_{15}$, $C_{17}$, and $C_{19}$ building blocks) are illustrated in FIG. 13 (dicarboxylic acids), 15 (aminocarboxylates), 16 (carboxylate semialdehydes), 18 (diamines), 19 (hydroxycarboxylates), and 26 (diols).

TABLE 2A

Intermediates in the Production of $C_{2n+3}$ Building Blocks

| n | $H_3COC(=O)(CH_2)_{2n+1}CO_2H$ (monomethyl carboxylate) | $H_3COC(=O)(CH_2)_{2n+1}CH(=O)$ (monomethyl carboxylate semialdehyde) | $H_2N(CH_2)_{2n+2}C(=O)OCH_3$ (monomethyl aminocarboxylate) | $HO(CH_2)_{2n+2}CH(=O)$ (hydroxyaldehyde) |
|---|---|---|---|---|
| 1 | monomethyl pentanedioate | methyl 5-oxopentanoate | monomethyl 5-aminopentanoate | 5-hydroxypentanal |
| 2 | monomethyl heptanedioate | methyl 7-oxoheptanoate | monomethyl 7-aminoheptanoate | 7-hydroxyheptanal |
| 3 | monomethyl nonanedioate | methyl 9-oxononanoate | monomethyl 9-aminononanoate | 9-hydroxynonanal |
| 4 | monomethyl undecanedioate | methyl 11-oxoundecanoate | monomethyl 11-aminoundecanoate | 11-hydroxyundecanal |
| 5 | monomethyl tridecanedioate | methyl 13-oxotridecanoate | monomethyl 13-aminotridecanoate | 13-hydroxytridecanal |
| 6 | monomethyl pentadecanedioate | methyl 15-oxopentadecanoate | monomethyl 15-aminopentadecanoate | 15-hydroxypentadecanal |
| 7 | monomethyl heptadecanedioate | methyl 17-oxoheptadecanoate | monomethyl 17-aminoheptadecanoate | 17-hydroxyheptadecanal |
| 8 | monomethyl nonadecanedioate | methyl 19-oxononadecanoate | monomethyl 19-aminononadecanoate | 19-hydroxynonadecanal |

TABLE 2B

Intermediates in the Production of $C_{2n+3}$ Building Blocks (cont.)

| n | $HO(CH_2)_{2n+3}NH_2$ (hydroxyamine) | $HC(=O)(CH_2)_{2n+2}NH_2$ (aminoaldehyde) | $HC(=O)(CH_2)_{2n+1}CH(=O)$ (dial) |
|---|---|---|---|
| 1 | 5-aminopentanol | 5-aminopentanal | 1,5-pentanedial |
| 2 | 7-aminoheptanol | 7-aminoheptanal | 1,7-heptanedial |
| 3 | 9-aminononanol | 9-aminononanal | 1,9-nonanedial |
| 4 | 11-aminoundecanol | 11-aminoundecanal | 1,11-undecanedial |
| 5 | 13-aminotridecanol | 13-aminotridecanal | 1,13-tridecanedial |
| 6 | 15-aminopentadecanol | 15-aminopentadecanal | 1,15-pentadecanedial |
| 7 | 17-aminoheptadecanol | 17-aminoheptadecanal | 1,17-heptadecanedial |
| 8 | 19-aminononadecanol | 19-aminononadecanal | 1,19-nonadecanedial |

TABLE 2C

Intermediates in the Production of $C_{2n+3}$ Building Blocks (cont.)

| n | $H_3CC(=O)NH(CH_2)_{2n+2}CO_2H$ (acetamidocarboxylate) | $H_3CC(=O)NH(CH_2)_{2n+2}CH(=O)$ (acetamidoaldehyde) | $H_3CC(=O)NH(CH_2)_{2n+3}NH_2$ (acetamidoamine) |
|---|---|---|---|
| 1 | N5-acetyl-5-aminopentanoate | N5-acetyl-5-aminopentanal | N5-acetyl-1,5-diaminopentane |
| 2 | N7-acetyl-7-aminoheptanoate | N7-acetyl-7-aminoheptanal | N7-acetyl-1,7-diaminoheptane |
| 3 | N9-acetyl-9-aminononanoate | N9-acetyl-9-aminononanal | N9-acetyl-1,9-diaminononane |
| 4 | N11-acetyl-11-aminoundecanoate | N11-acetyl-11-aminoundecanal | N11-acetyl-1,11-diaminoundecane |
| 5 | N13-acetyl-13-aminotridecanoate | N13-acetyl-13-aminotridecanal | N13-acetyl-1,13-diaminotridecane |
| 6 | N15-acetyl-15-aminopentadecanoate | N15-acetyl-15-aminopentadecanal | N15-acetyl-1,15-diaminopentadecane |
| 7 | N17-acetyl-17-aminoheptadecanoate | N17-acetyl-17-aminoheptadecanal | N17-acetyl-1,17-diaminoheptadecane |
| 8 | N19-acetyl-19-aminononadecanoate | N19-acetyl-19-aminononadecanal | N19-acetyl-1,19-diaminononadecane |

TABLE 3A $C_{2n+3}$ Building Blocks

| n | $HO_2C(CH_2)_{2n+1}CO_2H$ (dicarboxylic acid) | $HOC(=O)(CH_2)_{2n+1}CH(=O)$ (carboxylate semialdehyde) | $H_2N(CH_2)_{2n+2}CO_2H$ (aminocarboxylate) |
|---|---|---|---|
| 1 | pentanedioic acid | 5-oxopentanoate | 5-aminopentanoate |
| 2 | heptanedioic acid | 7-oxoheptanoate | 7-aminoheptanoate |
| 3 | nonanedioic acid | 9-oxononanoate | 9-aminononanoate |
| 4 | undecanedioic acid | 11-oxoundecanoate | 11-aminoundecanoate |
| 5 | tridecanedioic acid | 13-oxotridecanoate | 13-aminotridecanoate |

TABLE 3A-continued

$C_{2n+3}$ Building Blocks

| n | $HO_2C(CH_2)_{2n+1}CO_2H$ (dicarboxylic acid) | $HOC(=O)(CH_2)_{2n+1}CH(=O)$ (carboxylate semialdehyde) | $H_2N(CH_2)_{2n+2}CO_2H$ (aminocarboxylate) |
|---|---|---|---|
| 6 | pentadecanedioic acid | 15-oxopentadecanoate | 15-aminopentadecanoate |
| 7 | heptadecanedioic acid | 17-oxoheptadecanoate | 17-aminoheptadecanoate |
| 8 | nonadecanedioic acid | 19-oxononadecanoate | 19-aminononadecanoate |

TABLE 3B

$C_{2n+3}$ Building Blocks (cont.)

| n | $HO(CH_2)_{2n+2}CO_2H$ (hydroxycarboxylate) | $H_2N(CH_2)_{2n+3}NH_2$ (diamine) | $HO(CH_2)_{2n+3}OH$ (diol) |
|---|---|---|---|
| 1 | 5-hydroxypentanoate | pentane-1,5-diamine | 1,5-pentanediol |
| 2 | 7-hydroxyheptanoate | heptane-1,7-diamine | 1,7-heptanediol |
| 3 | 9-hydroxynonanoate | nonane-1,9-diamine | 1,9-nonanediol |
| 4 | 11-hydroxyundecanoate | undecane-1,11-diamine | 1,11-undecanediol |
| 5 | 13-hydroxytridecanoate | tridecane-1,13-diamine | 1,13-tridecanediol |
| 6 | 15-hydroxypentadecanoate | pentadecane-1,15-diamine | 1,15-pentadecanediol |
| 7 | 17-hydroxyheptadecanoate | heptadecane-1,17-diamine | 1,17-heptadecanediol |
| 8 | 19-hydroxynonadecanoate | nonadecane-1,19-diamine | 1,19-nonadecanediol |

Pathways Using NADPH-Specific Enzymes to Produce a Carboxyl-ACP Methyl Ester as a Central Precursor Leading to Difunctional Products In some embodiments, a $C_{2n+3}$ aliphatic backbone $H_3COC(=O)(CH_2)_{2n+1}C(=O)S$-ACP, also referred to as a carboxyl-ACP methyl ester, wherein n is an integer greater than or equal to one, such as, for example, one, two, three, four, five, six, seven, or eight, is synthesized from the central metabolite propanedioyl-[acp]. First, propanedioyl-[acp] is converted to propanedioyl-[acp] methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52). Second, propanedioyl-[acp] methyl ester is enzymatically converted to a carboxyl-ACP methyl ester $H_3COC(=O)(CH_2)_{2n+1}C(=O)S$-ACP via n cycles of methyl-ester shielded carbon chain elongation, wherein n is an integer greater than or equal to one, such as, for example, one, two, three, four, five, six, seven, or eight. See FIG. 1. Each cycle m of the n cycles of methyl-ester shielded carbon chain elongation includes: the conversion of $H_3COC(=O)(CH_2)_{2m-1}C(=O)S$-ACP with propanedioyl-[acp] to a 3-oxo-carboxyl-ACP methyl ester $H_3COC(=O)(CH_2)_{2m-1}C(=O)CH_2C(=O)S$-ACP by a polypeptide having the activity of a β-ketoacyl-[acp] synthase classified, for example, under EC 2.3.1.- (e.g., EC 2.3.1.41 or EC 2.3.1.179) when m is greater than 1 or EC 2.3.1.41, EC 2.3.1.179, or EC 2.3.1.180 when m is 1 (i.e., during the first cycle of methyl-ester shielded carbon chain elongation)) (e.g., a polypeptide having at least 50%, at least 60%, at least 70%, or at least 85% sequence homology to the amino acid sequence of any one of SEQ ID NOs: 14-16); followed by conversion to a 3-hydroxy-carboxyl-ACP methyl ester $H_3COC(=O)(CH_2)_{2m-1}CH(OH)CH_2C(=O)S$-ACP by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to a 2,3-dehydrocarboxyl-ACP methyl ester $H_3COC(=O)(CH_2)_{2m-1}CH=CHC(=O)S$-ACP by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to $H_3COC(=O)(CH_2)_{2m+1}C(=O)S$-ACP by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6). See FIG. 1.

Pathways Using NADPH-Specific Enzymes to Produce a Carboxyl-CoA Methyl Ester as a Central Precursor Leading to Difunctional Products In some embodiments, a $C_{2n+3}$ aliphatic backbone $H_3COC(=O)(CH_2)_{2n+1}C(=O)S$—CoA, also referred to as a carboxyl-CoA methyl ester, wherein n is an integer greater than or equal to one, such as, for example, one, two, three, four, five, six, seven, or eight, is synthesized from the central metabolite propanedioyl-CoA. First, propanedioyl-CoA is converted to propanedioyl-CoA methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52). Second, propanedioyl-CoA methyl ester is enzymatically converted to a $C_{2n+3}$ aliphatic backbone $H_3COC(=O)(CH_2)_{2n+1}C(=O)S$—CoA via n cycles of methyl-ester shielded carbon chain elongation, wherein n is an integer greater than or equal to one, such as, for example, one, two, three, four, five, six, seven, or eight. See FIG. 2. Each cycle m of the n cycles of methyl-ester shielded carbon chain elongation includes: the conversion of $H_3COC(=O)(CH_2)_{2m-1}C(=O)S$—CoA with acetyl-CoA to a 3-oxo-carboxyl-CoA methyl ester $H_3COC(=O)(CH_2)_{2m-1}C(=O)CH_2C(=O)S$—CoA by a polypeptide having the activity of a f-ketothiolase classified, for example, under EC 2.3.1.16

(e.g., a polypeptide having at least 50%, at least 60%, at least 70%, or at least 85% sequence homology to the amino acid sequence of SEQ ID NO: 17) or by conversion with propanedioyl-CoA by a polypeptide having the activity of a β-ketoacyl-[acp] synthase classified, for example, under EC 2.3.1.180 (e.g., a polypeptide having at least 50%, at least 60%, at least 70%, or at least 85% sequence homology to the amino acid sequence of any one of SEQ ID NOs: 14-16); followed by conversion to a 3-hydroxy-carboxyl-CoA methyl ester $H_3COC(=O)(CH_2)_{2m-1}CH(OH)CH_2C(=O)$S—CoA by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to $H_3COC(=O)(CH_2)_{2m-1}CH=CHC(=O)S$-CoA by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to $H_3COC(=O)(CH_2)_{2m+1}C(=O)S$—CoA by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7). See FIG. 2.

Pathways Using NADH-Specific Enzymes to Produce a Carboxyl-CoA Methyl Ester as a Central Precursor Leading to Difunctional Products In some embodiments, a $C_{2n+3}$ aliphatic backbone $H_3COC(=O)(CH_2)_{2n+1}C(=O)S$—CoA, also referred to as a carboxyl-CoA methyl ester, wherein n is an integer greater than or equal to one, such as, for example, one, two, three, four, five, six, seven, or eight, is synthesized from the central metabolite propanedioyl-CoA. First, propanedioyl-CoA is converted to propanedioyl-CoA methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52). Second, propanedioyl-CoA methyl ester is enzymatically converted to a carboxyl-CoA methyl ester $H_3COC(=O)(CH_2)_{2n+1}C(=O)S$—CoA via n cycles of methyl-ester shielded carbon chain elongation, wherein n is an integer greater than or equal to one, such as, for example, one, two, three, four, five, six, seven, or eight. See FIG. 3. Each cycle m of the n cycles of methyl-ester shielded carbon chain elongation includes: the conversion of $H_3COC(=O)(CH_2)_{2m-1}C(=O)S$—CoA with acetyl-CoA to a 3-oxo-carboxyl-CoA methyl ester $H_3COC(=O)(CH_2)_{2m-1}C(=O)CH_2C(=O)S$—CoA by a polypeptide having the activity of a β-ketothiolase classified, for example, under EC 2.3.1.16 (e.g., a polypeptide having at least 50%, at least 60%, at least 70%, or at least 85% sequence homology to the amino acid sequence of SEQ ID NO: 17) or by conversion with propanedioyl-CoA by a polypeptide having the activity of a β-ketoacyl-[acp] synthase classified, for example, under EC 2.3.1.180 (e.g., a polypeptide having at least 50%, at least 60%, at least 70%, or at least 85% sequence homology to the amino acid sequence any one of SEQ ID NOs: 14-16); followed by conversion to a 3-hydroxy-carboxyl-CoA methyl ester $H_3COC(=O)(CH_2)_{2m-1}CH(OH)CH_2C(=O)$S—CoA by a polypeptide having the activity of a 3-hydroxyacyl-CoA dehydrogenase classified, for example, under EC 1.1.1.- (e.g., EC 1.1.1.35) (e.g., a polypeptide having at least 50%, at least 60%, at least 70%, or at least 85% sequence homology to the amino acid sequence of SEQ ID NO: 2); followed by conversion to a 2,3-dehydrocarboxyl-CoA methyl ester $H_3COC(=O)(CH_2)_{2m-1}CH=CHC(=O)S$-CoA by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to $H_3COC(=O)(CH_2)_{2m+1}C(=O)S$—CoA by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46). See FIG. 3.

Pathways Using Carboxyl-CoA Methyl Esters and Carboxyl-ACP Methyl Esters as Central Precursors to Dicarboxylic Acids In some embodiments, a dicarboxylic acid $HO_2C(CH_2)_{2n+1}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$-ACP, by conversion of a carboxyl-ACP methyl ester $H_3COC(=O)(CH_2)_{2n+1}C(=O)S$-ACP to a monomethyl carboxylate $H_3COC(=O)(CH_2)_{2n+1}CO_2H$ by a polypeptide having the activity of a thioesterase classified, for example, under EC 3.1.1.2 (e.g., a polypeptide having at least 50%, at least 60%, at least 70%, or at least 85% sequence homology to the amino acid sequence of SEQ ID NO: 82), EC 3.1.1.5 (e.g., a polypeptide having at least 50%, at least 60%, at least 70%, or at least 85% sequence homology to the amino acid sequence of SEQ ID NO: 84), or EC 3.1.2.-, such as EC 3.1.2.14, EC 3.1.2.21, or EC 3.1.2.27 (e.g., a polypeptide having at least 50%, at least 60%, at least 70%, or at least 85% sequence homology to the amino acid sequence of SEQ ID NO: 93), or a polypeptide having at least 50%, at least 60%, at least 70%, or at least 85% sequence homology to the amino acid sequence of any one of SEQ ID NOs: 58-113 or SEQ ID NOs: 182-195; followed by conversion to a dicarboxylic acid $HO_2C(CH_2)_{2n+1}CO_2H$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 4.

In some embodiments, a dicarboxylic acid $HO_2C(CH_2)_{2n+1}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$—CoA, by conversion of a carboxyl-CoA methyl ester $H_3COC(=O)(CH_2)_{2n+1}C(=O)S$—CoA to a monomethyl carboxylate $H_3COC(=O)(CH_2)_{2n+1}CO_2H$ by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to a dicarboxylic acid $HO_2C(CH_2)_{2n+1}CO_2H$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 4.

In some embodiments, a dicarboxylic acid $HO_2C(CH_2)_{2n+1}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$—CoA, by conversion of a carboxyl-CoA methyl ester $H_3COC(=O)(CH_2)_{2n+1}C(=O)S$—CoA to a monomethyl carboxylate $H_3COC(=O)(CH_2)_{2n+1}CO_2H$ by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to a dicarboxylic acid $HO_2C(CH_2)_{2n+1}CO_2H$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 4.

In some embodiments, a dicarboxylic acid $HO_2C(CH_2)_{2n+1}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$—CoA, by conversion of a carboxyl-CoA methyl ester $H_3COC(=O)(CH_2)_{2n+1}C(=O)S$—CoA to a monomethyl carboxylate semialdehyde $H_3COC(=O)(CH_2)_{2n+1}CH(=O)$ by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to a monomethyl carboxylate $H_3COC(=O)(CH_2)_{2n+1}CO_2H$ by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1. (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to a dicarboxylic acid $HO_2C(CH_2)_{2n+1}CO_2H$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 4.

In some embodiments, a dicarboxylic acid $HO_2C(CH_2)_{2n+1}CO_2H$, wherein n is an integer greater than or equal to one, such as, for example, one, two, three, four, five, six, seven, or eight, is synthesized from the central precursor, $H_3COC(=O)(CH_2)_{2n+1}CH(=O)$, by conversion of a monomethyl carboxylate semialdehyde $H_3COC(=O)(CH_2)_{2n+1}CH(=O)$ to a monomethyl carboxylate $H_3COC(=O)(CH_2)_{2n+1}CO_2H$ by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to a dicarboxylic acid $HO_2C(CH_2)_{2n+1}CO_2H$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 4.

Pathways Using a Carboxyl-CoA Methyl Ester or a Monomethyl Carboxylate Semialdehyde as a Central Precursor to an Aminocarboxylate In some embodiments, an aminocarboxylate $H_2N(CH_2)_{2n+2}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$—CoA, by conversion of a carboxyl-CoA methyl ester $H_3COC(=O)(CH_2)_{2n+1}C(=O)S$—CoA to a monomethyl carboxylate semialdehyde $H_3COC(=O)(CH_2)_{2n+1}CH(=O)$ by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of the monomethyl carboxylate semialdehyde $H_3COC$ (=O)(CH$_2$)$_{2n+1}$CH(=O) to a monomethyl aminocarboxylate H$_2$N(CH$_2$)$_{2n+2}$C(=O)OCH$_3$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of the monomethyl aminocarboxylate H2N(CH$_2$)$_{2n+2}$C(=O)OCH$_3$ to an aminocarboxylate H$_2$N(CH$_2$)$_{2n+2}$CO$_2$H by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 5.

In some embodiments, an aminocarboxylate H$_2$N(CH$_2$)$_{2n+2}$CO$_2$H, wherein n is an integer greater than or equal to one, such as, for example, one, two, three, four, five, six, seven, or eight, is synthesized from the central precursor, H$_3$COC(=O)(CH$_2$)$_{2n+1}$CH(=O), by conversion of the monomethyl carboxylate semialdehyde H$_3$COC(=O)(CH$_2$)$_{2n+1}$CH(=O) to a monomethyl aminocarboxylate H$_2$N(CH$_2$)$_{2n+2}$C(=O)OCH$_3$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of the monomethyl aminocarboxylate H$_2$N(CH$_2$)$_{2n+2}$C(=O)OCH$_3$ to an aminocarboxylate H$_2$N(CH$_2$)$_{2n+2}$CO$_2$H by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 5.

In some embodiments, an aminocarboxylate H$_2$N(CH$_2$)$_{2n+2}$CO$_2$H, wherein n is an integer greater than or equal to one, such as, for example, one, two, three, four, five, six, seven, or eight, is synthesized from the central precursor, H$_3$COC(=O)(CH$_2$)$_{2n+1}$CO$_2$H, by conversion of the monomethyl carboxylate H$_3$COC(=O)(CH$_2$)$_{2n+1}$CO$_2$H to a monomethyl carboxylate semialdehyde H$_3$COC(=O)(CH$_2$)$_{2n+1}$CH(=O) by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of aphosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the monomethyl carboxylate semialdehyde H$_3$COC(=O)(CH$_2$)$_{2n+1}$CH(=O) to a monomethyl aminocarboxylate H$_2$N(CH$_2$)$_{2n+2}$C(=O)OCH$_3$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8 or a polypeptide having at least 50%, at least 60%, at least 70%, or at least 85% sequence homology to the amino acid sequence of any one of SEQ ID NOs: 116-138 or SEQ ID NOs: 167-181; followed by conversion of the monomethyl aminocarboxylate H$_2$N(CH$_2$)$_{2n+2}$C(=O)OCH$_3$ to an aminocarboxylate H$_2$N(CH$_2$)$_{2n+2}$CO$_2$H by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 5.

In some embodiments, an aminocarboxylate H$_2$N(CH$_2$)$_{2n+2}$CO$_2$H, wherein n is an integer greater than or equal to one, such as, for example, one, two, three, four, five, six, seven, or eight, is synthesized from the central precursor, HO$_2$C(CH$_2$)$_{2n+1}$CO$_2$H, by conversion of the dicarboxylic acid HO$_2$C(CH$_2$)$_{2n+1}$CO$_2$H to a carboxylate semialdehyde HOC(=O)(CH$_2$)$_{2n+1}$CH(=O) by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the carboxylate semialdehyde HOC(=O)(CH$_2$)$_{2n+1}$CH(=O) to an aminocarboxylate H$_2$N(CH$_2$)$_{2n+2}$CO$_2$H by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 5.

Pathways Using Aminocarboxylate, Hydroxycarboxylate, or Carboxylate Semialdehyde as Central Precursors to Diamine In some embodiments, a diamine H$_2$N(CH$_2$)$_{2n+3}$NH$_2$, wherein n is an integer greater than or equal to one, such as, for example, one, two, three, four, five, six, seven, or eight, is synthesized from the central precursor, H$_2$N(CH$_2$)$_{2n+2}$CO$_2$H, by conversion of the aminocarboxylate H$_2$N(CH$_2$)$_{2n+2}$CO$_2$H to an aminoaldehyde HC(=O)(CH$_2$)$_{2n+2}$NH$_2$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the aminoaldehyde HC(=O)(CH$_2$)$_{2n+2}$NH$_2$ to a diamine H$_2$N(CH$_2$)$_{2n+3}$NH$_2$ by a polypeptide having the activity of an aminotransferase classified, for example, under EC 2.6.1.-, such as EC 2.6.1.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 6A.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, a diamine $H_2N(CH_2)_{2n+3}NH_2$, wherein n is an integer greater than or equal to one, such as, for example, one, two, three, four, five, six, seven, or eight, is synthesized from the central precursor, $HO(CH_2)_{2n+2}CO_2H$ (which can be produced as described in FIG. 7), by conversion of the hydroxycarboxylate $HO(CH_2)_{2n+2}CO_2H$ to an hydroxyaldehyde $HO(CH_2)_{2n+2}CH(=O)$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the hydroxyaldehyde $HO(CH_2)_{2n+2}CH(=O)$ to a hydroxylamine $HO(CH_2)_{2n+3}NH_2$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to an aminoaldehyde $HC(=O)(CH_2)_{2n+2}NH_2$ by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to a diamine $H_2N(CH_2)_{2n+3}NH_2$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 6A.

In some embodiments, a diamine $H_2N(CH_2)_{2n+3}NH_2$, wherein n is an integer greater than or equal to one, such as, for example, one, two, three, four, five, six, seven, or eight, is synthesized from the central precursor, $H_2N(CH_2)_{2n+2}CO_2H$, by conversion of an aminocarboxylate $H_2N(CH_2)_{2n+2}CO_2H$ to an acetamidocarboxylate $H_3CC(=O)NH(CH_2)_{2n+2}CO_2H$ by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to an acetamidoaldehyde $H_3CC(=O)NH(CH_2)_{2n+2}CH(=O)$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to an acetamidoamine $H_3CC(=O)NH(CH_2)_{2n+3}NH_2$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to a diamine $H_2N(CH_2)_{2n+3}NH_2$ by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45). See FIG. 6B.

In some embodiments, a diamine $H_2N(CH_2)_{2n+3}NH_2$, wherein n is an integer greater than or equal to one, such as, for example, one, two, three, four, five, six, seven, or eight, is synthesized from the central precursor, $HOC(=O)(CH_2)_{2n+1}CH(=O)$, by conversion of the carboxylate semialdehyde $HOC(=O)(CH_2)_{2n+1}CH(=O)$ to a dial $HC(=O)(CH_2)_{2n+1}CH(=O)$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to an aminoaldehyde $HC(=O)(CH_2)_{2n+2}NH_2$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to a diamine $H_2N(CH_2)_{2n+3}NH_2$ by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 6B.

Pathways Using a Carboxylate Semialdehyde or a Carboxyl-CoA Methyl Ester as a Central Precursor to a Hydroxycarboxylate In some embodiments, a hydroxycarboxylate $HO(CH_2)_{2n+2}CO_2H$, wherein n is an integer greater than or equal to one, such as, for example, one, two, three, four, five, six, seven, or eight, is synthesized from the central precursor, $HO_2C(CH_2)_{2n+1}CO_2H$, by conversion of the dicarboxylic acid $HO_2C(CH_2)_{2n+1}CO_2H$ to a carboxylate semialdehyde $HOC(=O)(CH_2)_{2n+1}CH(=O)$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to a hydroxycarboxylate HO$(CH_2)_{2n+2}CO_2H$ by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23). See FIG. 7.

In some embodiments, a hydroxycarboxylate HO$(CH_2)_{2n+2}CO_2H$, wherein n is an integer greater than or equal to one, such as, for example, one, two, three, four, five, six, seven, or eight, is synthesized from the central precursor, $H_3COC(=O)(CH_2)_{2n+1}C(=O)S$—CoA, by conversion of the carboxyl-CoA methyl ester $H_3COC(=O)(CH_2)_{2n+1}C(=O)S$—CoA to a monomethyl carboxylate semialdehyde $H_3COC(=O)(CH_2)_{2n+1}CH(=O)$ by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of the monomethyl carboxylate semialdehyde $H_3COC(=O)(CH_2)_{2n+1}CH(=O)$ to a carboxylate semialdehyde $HOC(=O)(CH_2)_{2n+1}CH(=O)$ by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to a hydroxycarboxylate HO$(CH_2)_{2n+2}CO_2H$ by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23). See FIG. 7.

Pathways Using a Hydroxycarboxylate as a Central Precursor to a Diol

In some embodiments, a diol HO$(CH_2)_{2n+3}$OH, wherein n is an integer greater than or equal to one, such as, for example, one, two, three, four, five, six, seven, or eight, is synthesized from the central precursor, HO$(CH_2)_{2n+2}CO_2H$, by conversion of the hydroxycarboxylate HO$(CH_2)_{2n+2}CO_2H$ to a hydroxyaldehyde HO$(CH_2)_{2n+2}CH(=O)$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the hydroxyaldehyde HO$(CH_2)_{2n+2}CH(=O)$ to a diol HO$(CH_2)_{2n+3}$OH by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23). See FIG. 8.

Pathways Using an Aminocarboxylate as a Central Precursor to a Hydroxyamine

In some embodiments, a hydroxyamine HO$(CH_2)_{2n+3}NH_2$, wherein n is an integer greater than or equal to one, such as, for example, one, two, three, four, five, six, seven, or eight, is synthesized from the central precursor, $H_2N(CH_2)_{2n+2}CO_2H$, by conversion of the aminocarboxylate $H_2N(CH_2)_{2n+2}CO_2H$ to an aminoaldehyde HC(=O)$(CH_2)_{2n+2}NH_2$ by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of the aminoaldehyde HC(=O)$(CH_2)_{2n+2}NH_2$ to a hydroxyamine HO$(CH_2)_{2n+3}NH_2$ by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23). See FIG. 6A.

$C_5$ Biochemical Pathways

Figure 33:
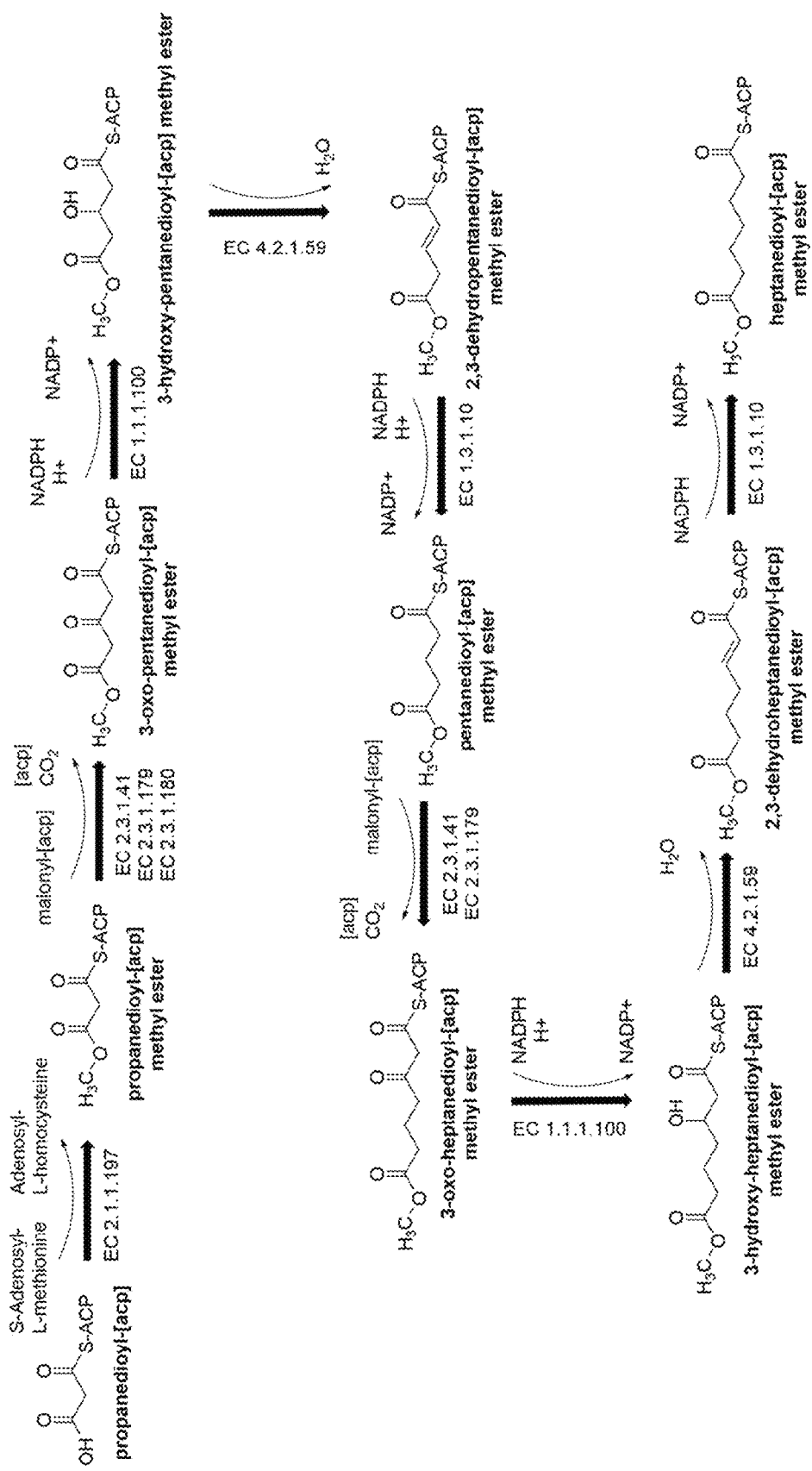
FIG. 33 is a schematic of an example biochemical pathway leading to heptanedioyl-[acp]methyl ester using polypeptides having the activity of one or more NADPH-dependent enzymes and propanedioyl-[acp] as central metabolites.

Pathways Using NADPH-Specific Enzymes to Produce Pentanedioyl-[Acp] Methyl Ester as a Central Precursor Leading to $C_5$ Building Blocks In some embodiments, pentanedioyl-[acp] methyl ester is synthesized from the central metabolite propanedioyl-[acp] via one cycle of methyl-ester shielded carbon chain elongation by conversion of propanedioyl-[acp] to propanedioyl-[acp] methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52); followed by conversion with propanedioyl-[acp] to 3-oxo-pentanedioyl-[acp] methyl ester by a polypeptide having the activity of a β-ketoacyl-[acp] synthase classified, for example, under EC 2.3.1.- (e.g., EC 2.3.1.41, EC 2.3.1.179, or EC 2.3.1.180) (e.g., a polypeptide having at least 50%, at least 60%, at least 70%, or at least 85% sequence homology to the amino acid sequence of any one of SEQ ID NOs: 14-16); followed by conversion to 3-hydroxy-pentanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydropentanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to pentanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6). See FIG. 33.

Figure 34:
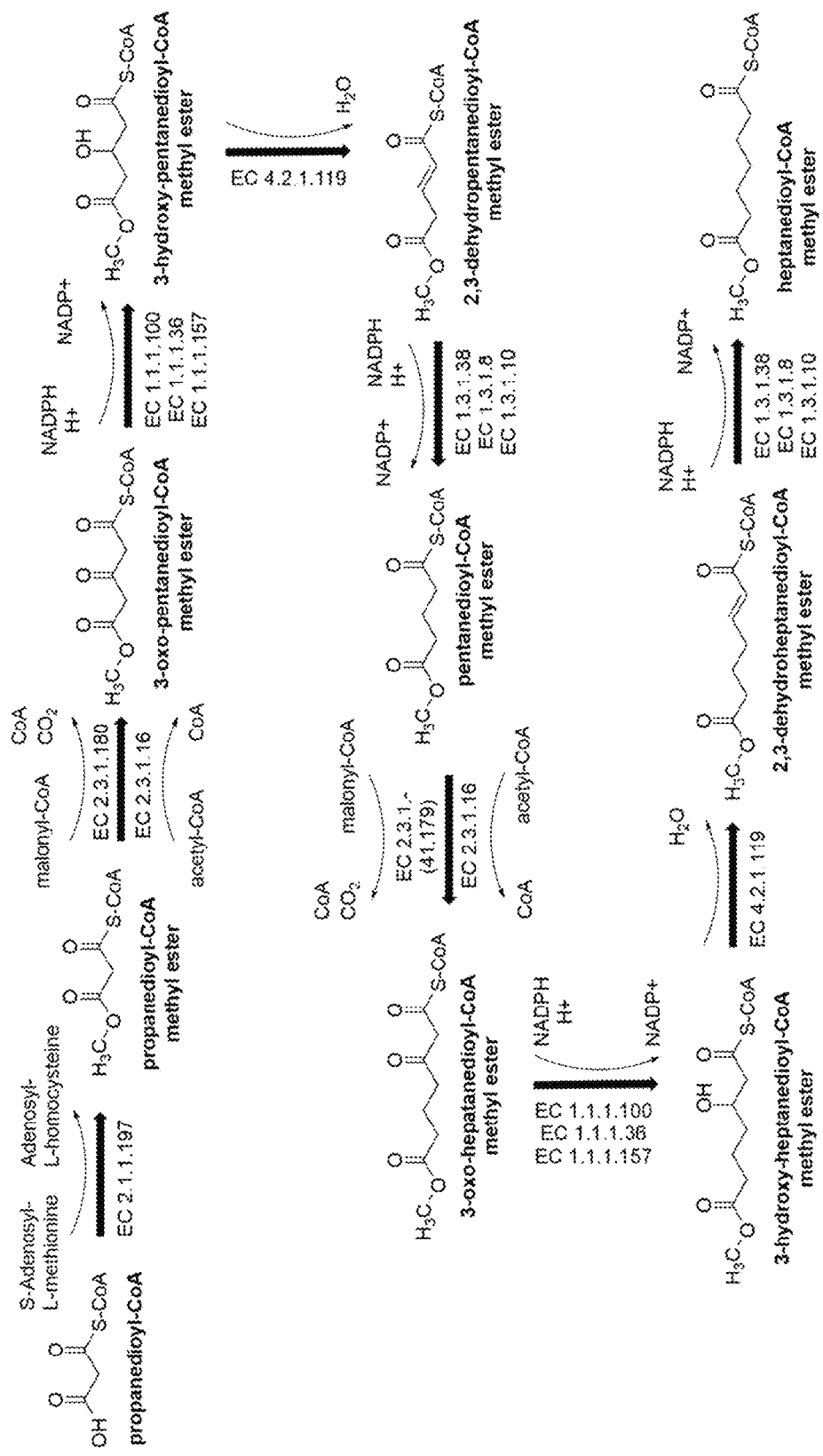
FIG. 34 is a schematic of an example biochemical pathway leading to heptanedioyl-CoA methyl ester using polypeptides having the activity of one or more NADPH-dependent enzymes and acetyl-CoA and propanedioyl-CoA as central metabolites.

Pathways Using NADPH-Specific Enzymes to Produce Pentanedioyl-CoA Methyl Ester as a Central Precursor Leading to $C_5$ Building Blocks In some embodiments, pentanedioyl-CoA methyl ester is synthesized from the central metabolite propanedioyl-CoA via one cycle of methyl-ester shielded carbon chain elongation by conversion of propanedioyl-CoA to propanedioyl-CoA methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52); followed by conversion with acetyl-CoA to 3-oxo-pentanedioyl-CoA methyl ester by a polypeptide having the activity of a β-ketothiolase classified, for example, under EC 2.3.1.16 (e.g., a polypeptide having at least 50%, at least 60%, at least 70%, or at least 85% sequence homology to the amino acid sequence of SEQ ID NO: 17) or by conversion with propanedioyl-CoA by a polypeptide having the activity of a β-ketoacyl-[acp] synthase classified, for example, under EC 2.3.1.180 (e.g., a polypeptide having at least 50%, at least 60%, at least 70%, or at least 85% sequence homology to the amino acid sequence of any one of SEQ ID NOs: 14-16); followed by conversion to 3-hydroxy-pentanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydropentanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to pentanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7). See FIG. 34.

Figure 35:
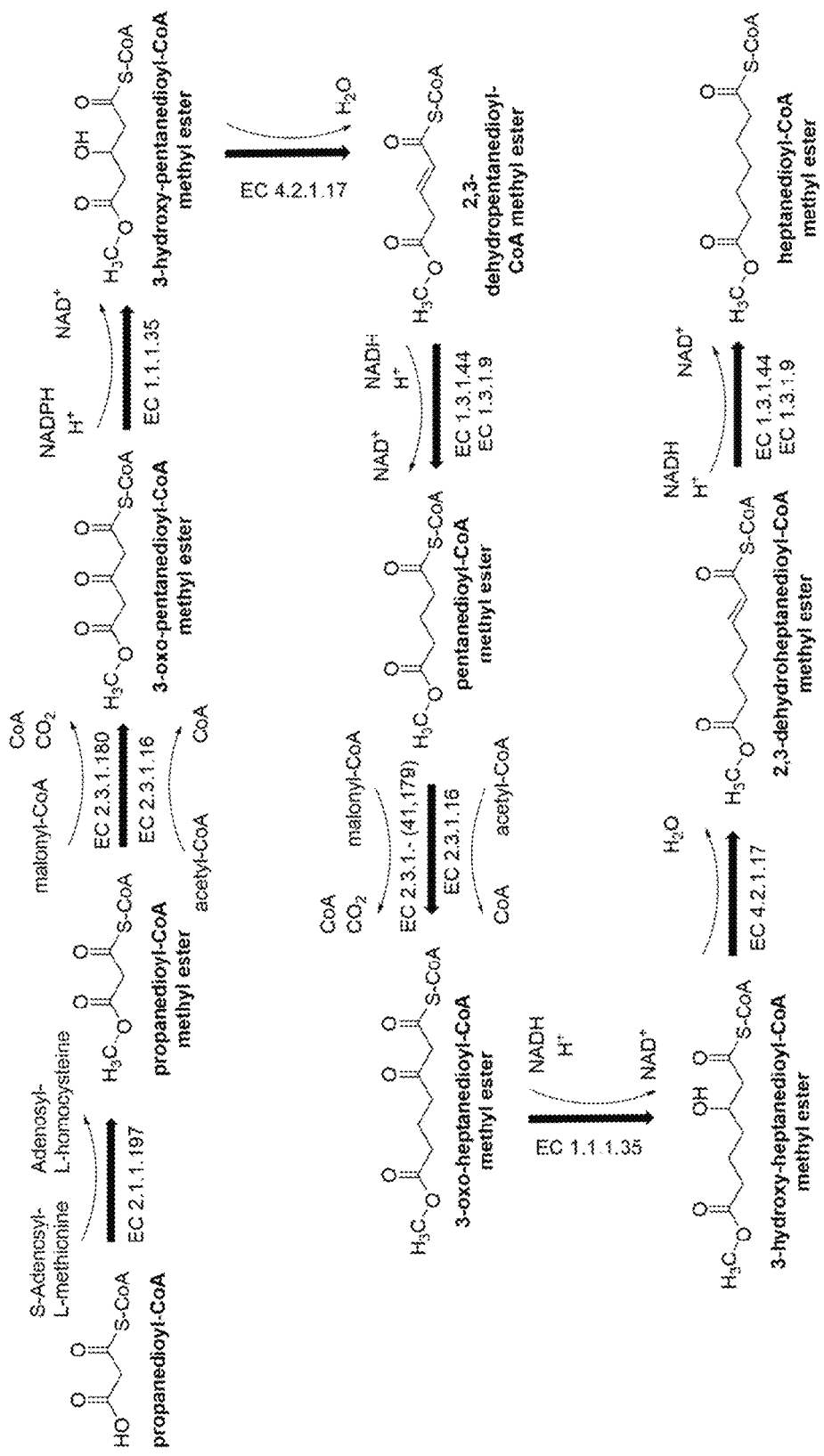
FIG. 35 is a schematic of an example biochemical pathway leading to heptanedioyl-CoA methyl ester using polypeptides having the activity of one or more NADH-dependent enzymes and acetyl-CoA and propanedioyl-CoA as central metabolites.

Pathways Using NADH-Specific Enzymes to Produce Pentanedioyl-CoA Methyl Ester as a Central Precursor Leading to $C_5$ Building Blocks In some embodiments, pentanedioyl-CoA methyl ester is synthesized from the central metabolite propanedioyl-CoA via one cycle of methyl-ester shielded carbon chain elongation by conversion of propanedioyl-CoA to propanedioyl-CoA methyl ester by a polypeptide having the activity of a S-adenosyl-L-methionine (SAM)-dependent methyltransferase classified, for example, under EC 2.1.1.197 (e.g., a polypeptide having at least 50%, at least 60%, at least 70%, or at least 85% sequence homology to the amino acid sequence of SEQ ID NO: 52); followed by conversion with acetyl-CoA to 3-oxo-pentanedioyl-CoA methyl ester by a polypeptide having the activity of a β-ketothiolase classified, for example, under EC 2.3.1.16 (e.g., a polypeptide having at least 50%, at least 60%, at least 70%, or at least 85% sequence homology to the amino acid sequence of SEQ ID NO: 17) or by conversion with propanedioyl-CoA by a polypeptide having the activity of a β-ketoacyl-[acp] synthase classified, for example, under EC 2.3.1.180 (e.g., a polypeptide having at least 50%, at least 60%, at least 70%, or at least 85% sequence homology to the amino acid sequence any one of SEQ ID NOs: 14-16); followed by conversion to 3-hydroxy-pentanedioyl-CoA methyl ester by a polypeptide having the activity of a 3-hydroxyacyl-CoA dehydrogenase classified, for example, under EC 1.1.1.- (e.g., EC 1.1.1.35) (e.g., a polypeptide having at least 50%, at least 60%, at least 70%, or at least 85% sequence homology to the amino acid sequence of SEQ ID NO: 2); followed by conversion to 2,3-dehydropentanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to pentanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46). See FIG. 35.

Pathways Using Pentanedioyl-CoA Methyl Ester or Pentanedioyl-[Acp] Methyl Ester as Central Precursors to Pentanedioic Acid In some embodiments, pentanedioic acid is synthesized from the central precursor, pentanedioyl-[acp] methyl ester, by conversion of pentanedioyl-[acp] methyl ester to monomethyl pentanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to pentanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentanedioic acid is synthesized from the central precursor, pentanedioyl-CoA methyl ester, by conversion of pentanedioyl-CoA methyl ester to monomethyl pentanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to pentanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentanedioic acid is synthesized from the central precursor, pentanedioyl-CoA methyl ester, by conversion of pentanedioyl-CoA methyl ester to monomethyl pentanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to pentanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentanedioic acid is synthesized from the central precursor, pentanedioyl-CoA methyl ester, by conversion of pentanedioyl-CoA methyl ester to methyl 5-oxopentanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl pentanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to pentanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentanedioic acid is synthesized from the central precursor, methyl 5-oxopentanoate, by conversion of methyl 5-oxopentanoate to monomethyl pentanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1. (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to pentanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Pentanedioyl-CoA Methyl Ester or Methyl 5-Oxopentanoate as a Central Precursor to 5-Aminopentanoate In some embodiments, 5-aminopentanoate is synthesized from the central precursor, pentanedioyl-CoA methyl ester, by conversion of pentanedioyl-CoA methyl ester to methyl 5-oxopentanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 5-oxopentanoate to monomethyl 5-aminopentanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 5-aminopentanoate to 5-aminopentanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 5-aminopentanoate is synthesized from the central precursor, methyl 5-oxopentanoate, by conversion of methyl 5-oxopentanoate to monomethyl 5-aminopentanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 5-aminopentanoate to 5-aminopentanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 5-aminopentanoate is synthesized from the central precursor, monomethyl pentanedioate, by conversion of monomethyl pentanedioate to methyl 5-oxopentanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 5-oxopentanoate to monomethyl 5-aminopentanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 5-aminopentanoate to 5-aminopentanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 5-aminopentanoate is synthesized from the central precursor, pentanedioic acid, by conversion of pentanedioic acid to 5-oxopentanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 5-oxopentanoate to 5-aminopentanoate by a polypeptide having the activity of an aminotransferase classified, for example, under EC 2.6.1.-, such as EC 2.6.1.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 5-Aminopentanoate, 5-Hydroxypentanoate, or 5-Oxopentanoate as Central Precursors to Pentane-1,5-Diamine In some embodiments, pentane-1,5-diamine is synthesized from the central precursor, 5-aminopentanoate, by conversion of 5-aminopentanoate to 5-aminopentanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 5-aminopentanal to pentane-1,5-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, pentane-1,5-diamine is synthesized from the central precursor, 5-hydroxypentanoate, by conversion of 5-hydroxypentanoate to 5-hydroxypentanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 5-hydroxypentanal to 5-aminopentanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 5-aminopentanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to pentane-1,5-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, pentane-1,5-diamine is synthesized from the central precursor, 5-aminopentanoate, by conversion of 5-aminopentanoate to N5-acetyl-5-aminopentanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N5-acetyl-5-aminopentanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N5-acetyl-1,5-diaminopentane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to pentane-1,5-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, pentane-1,5-diamine is synthesized from the central precursor, 5-oxopentanoate, by conversion of 5-oxopentanoate to 1,5-pentanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 5-aminopentanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to pentane-1,5-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Pentanedioic Acid or Pentanedioyl-CoA Methyl Ester as a Central Precursor to 5-Hydroxypentanoate In some embodiments, 5-hydroxypentanoate is synthesized from the central precursor, pentanedioic acid, by conversion of pentanedioic acid to 5-oxopentanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 5-hydroxypentanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 5-hydroxypentanoate is synthesized from the central precursor, pentanedioyl-CoA methyl ester, by conversion of pentanedioyl-CoA methyl ester to methyl 5-oxopentanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 5-oxopentanoate to 5-oxopentanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 5-hydroxypentanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 5-Hydroxypentanoate as a Central Precursor to 1,5-Pentanediol

In some embodiments, 1,5-pentanediol is synthesized from the central precursor, 5-hydroxypentanoate, by conversion of 5-hydroxypentanoate to 5-hydroxypentanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 5-hydroxypentanal to 1,5-pentanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 5-Aminopentanoate as a Central Precursor to 5-Aminopentanol

In some embodiments, 5-aminopentanol is synthesized from the central precursor, 5-aminopentanoate, by conversion of 5-aminopentanoate to 5-aminopentanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 5-aminopentanal to 5-aminopentanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_7$ Biochemical Pathways

Pathways Using NADPH-Specific Enzymes to Produce Heptanedioyl-[Acp] Methyl Ester as a Central Precursor Leading to $C_7$ Building Blocks In some embodiments, heptanedioyl-[acp] methyl ester is synthesized from the central metabolite propanedioyl-[acp] via two cycles of methyl-ester shielded carbon chain elongation by conversion of propanedioyl-[acp] to pentanedioyl-[acp] methyl ester as described above; followed by conversion to 3-oxo-heptanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-heptanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydroheptanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to heptanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6). See FIG. 33.

Pathways Using NADPH-Specific Enzymes to Produce Heptanedioyl-CoA Methyl Ester as a Central Precursor Leading to $C_7$ Building Blocks In some embodiments, heptanedioyl-CoA methyl ester is synthesized from the central metabolite propanedioyl-CoA via two cycles of methyl-ester shielded carbon chain elongation by conversion of propanedioyl-CoA to pentanedioyl-CoA methyl ester as described above; followed by conversion to 3-oxo-heptanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-heptanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydroheptanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to heptanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7). See FIG. 34.

Pathways Using NADH-Specific Enzymes to Produce Heptanedioyl-CoA Methyl Ester as a Central Precursor Leading to C₇ Building Blocks In some embodiments, heptanedioyl-CoA methyl ester is synthesized from the central metabolite propanedioyl-CoA via two cycles of methyl-ester shielded carbon chain elongation by conversion of propanedioyl-CoA to pentanedioyl-CoA methyl ester as described above; followed by conversion to 3-oxo-heptanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a 6-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-heptanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydroheptanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to heptanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46). See FIG. 35.

Figure 36:
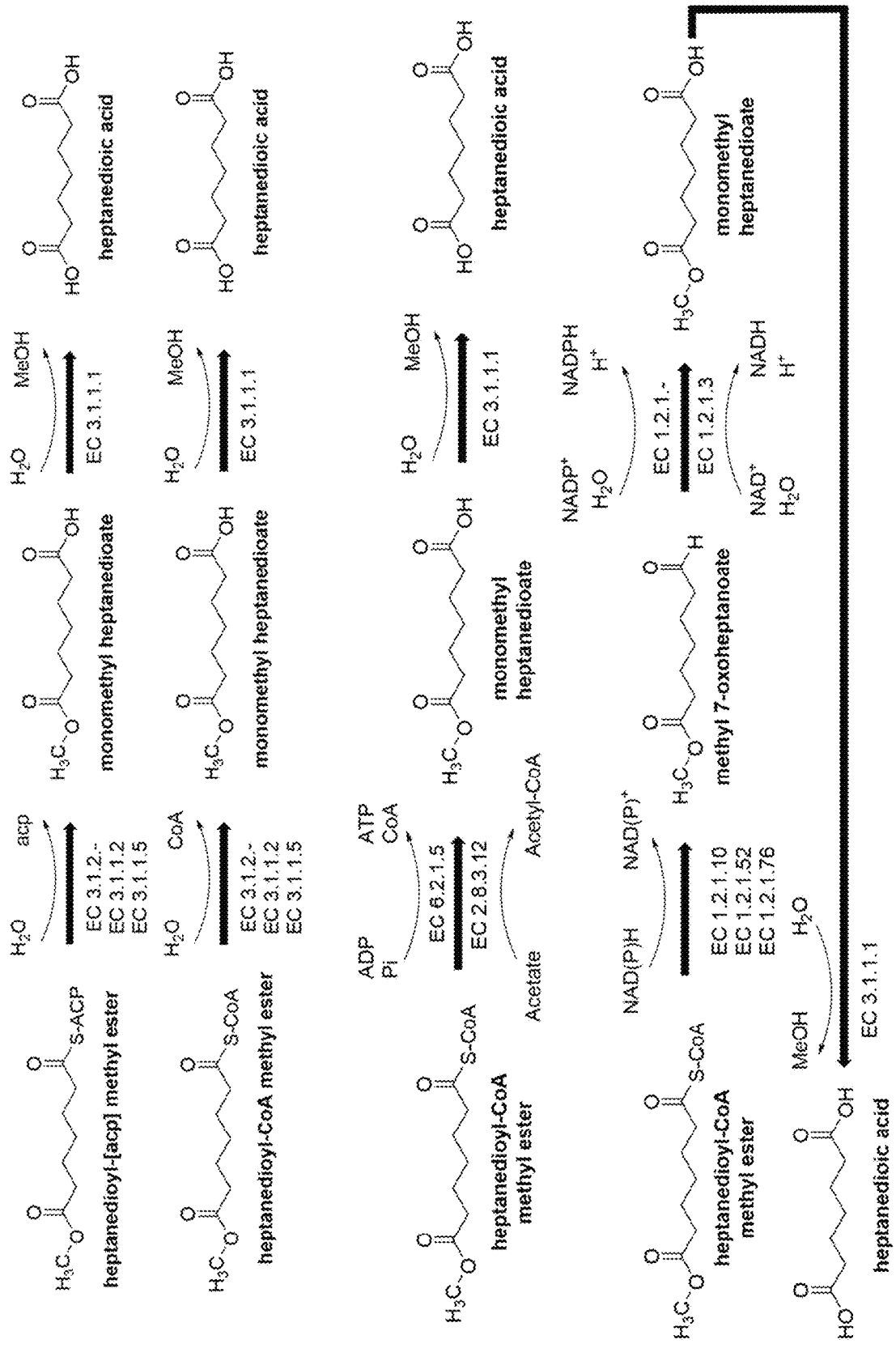
FIG. 36 is a schematic of example biochemical pathways leading to heptanedioate using heptanedioyl-[acp] methyl ester, heptanedioyl-CoA methyl ester, or methyl 7-oxoheptanoate as central precursors.

Pathways Using Heptanedioyl-CoA Methyl Ester or Heptanedioyl-[Acp] Methyl Ester as Central Precursors to Heptanedioic Acid In some embodiments, heptanedioic acid is synthesized from the central precursor, heptanedioyl-[acp] methyl ester, by conversion of heptanedioyl-[acp] methyl ester to monomethyl heptanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to heptanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 36.

In some embodiments, heptanedioic acid is synthesized from the central precursor, heptanedioyl-CoA methyl ester, by conversion of heptanedioyl-CoA methyl ester to monomethyl heptanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to heptanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 36.

In some embodiments, heptanedioic acid is synthesized from the central precursor, heptanedioyl-CoA methyl ester, by conversion of heptanedioyl-CoA methyl ester to monomethyl heptanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to heptanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 36.

In some embodiments, heptanedioic acid is synthesized from the central precursor, heptanedioyl-CoA methyl ester, by conversion of heptanedioyl-CoA methyl ester to methyl 7-oxoheptanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl heptanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1. (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to heptanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 36.

In some embodiments, heptanedioic acid is synthesized from the central precursor, methyl 7-oxoheptanoate, by conversion of methyl 7-oxoheptanoate to monomethyl heptanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1. (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to heptanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 36.

Figure 37:
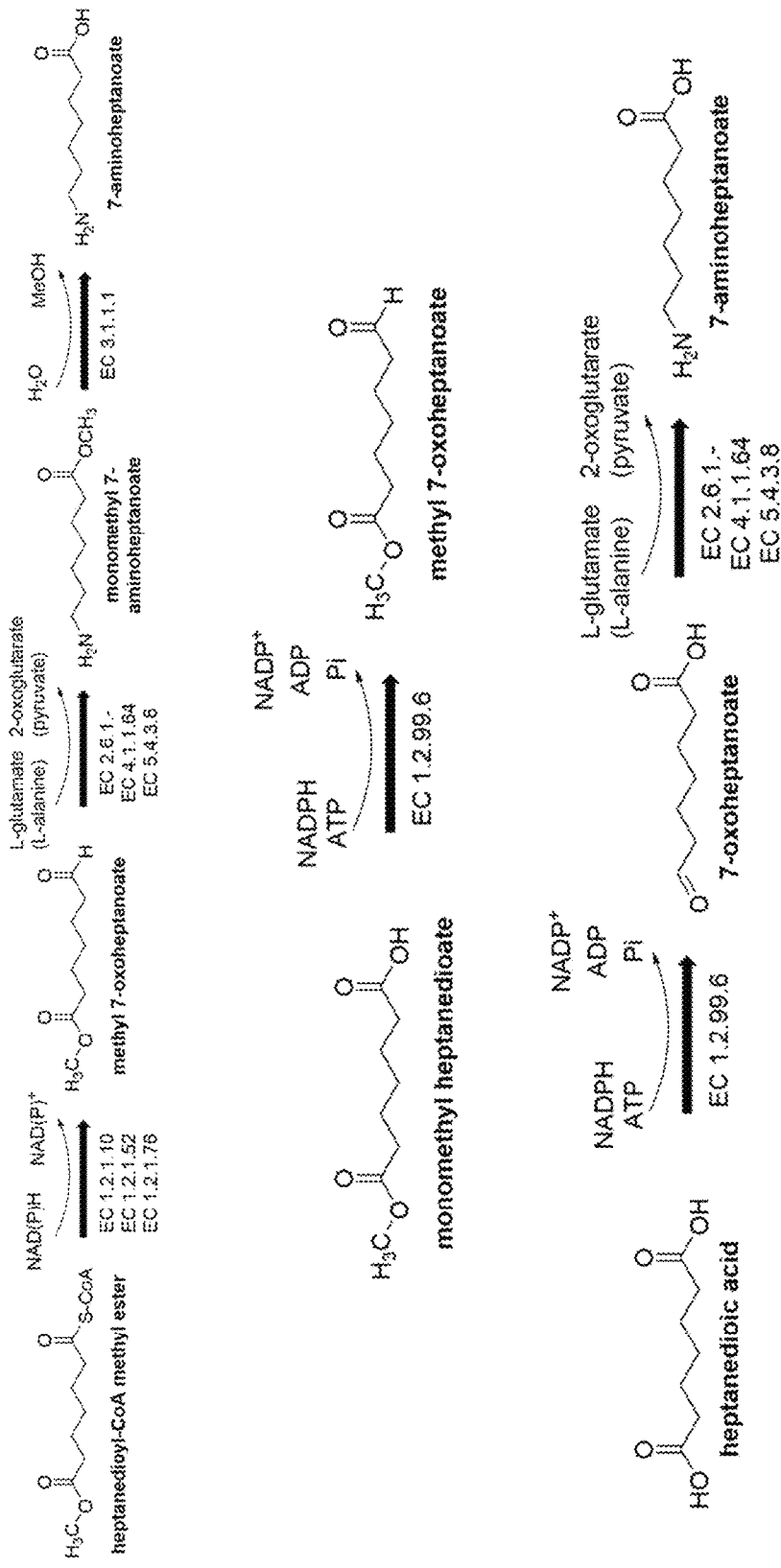
FIG. 37 is a schematic of example biochemical pathways leading to 7-aminoheptanoate using heptanedioyl-CoA methyl ester, monomethyl heptanedioate, methyl 7-oxoheptanoate, monomethyl 7-aminoheptanoate, or heptanedioate as central precursors.

Pathways Using Heptanedioyl-CoA Methyl Ester or Methyl 7-Oxoheptanoate as a Central Precursor to 7-Aminoheptanoate In some embodiments, 7-aminoheptanoate is synthesized from the central precursor, heptanedioyl-CoA methyl ester, by conversion of heptanedioyl-CoA methyl ester to methyl 7-oxoheptanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 7-oxoheptanoate to monomethyl 7-aminoheptanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 7-aminoheptanoate to 7-aminoheptanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 37.

In some embodiments, 7-aminoheptanoate is synthesized from the central precursor, methyl 7-oxoheptanoate, by conversion of methyl 7-oxoheptanoate to monomethyl 7-aminoheptanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.38, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 7-aminoheptanoate to 7-aminoheptanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 37.

In some embodiments, 7-aminoheptanoate is synthesized from the central precursor, monomethyl heptanedioate, by conversion of monomethyl heptanedioate to methyl 7-oxoheptanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 7-oxoheptanoate to monomethyl 7-aminoheptanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 7-aminoheptanoate to 7-aminoheptanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51). See FIG. 37.

In some embodiments, 7-aminoheptanoate is synthesized from the central precursor, heptanedioic acid, by conversion of heptanedioic acid to 7-oxoheptanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 7-oxoheptanoate to 7-aminoheptanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 37.

Figure 38:
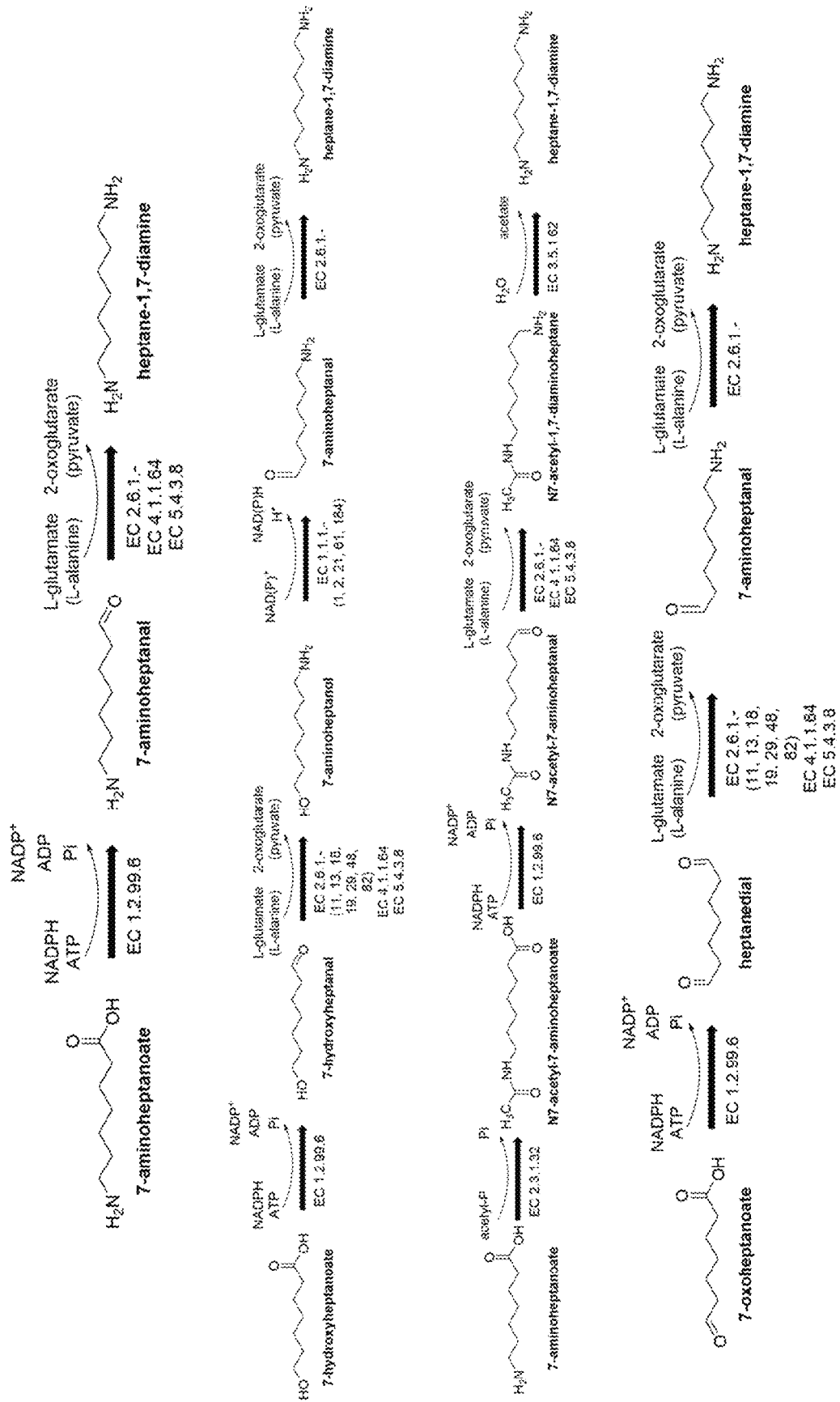
FIG. 38 is a schematic of exemplary biochemical pathways leading to heptane-1,7-diamine using 7-aminoheptanoate, 7-hydroxyheptanoate or 7-oxoheptanoate as central precursors.

Pathways Using 7-Aminoheptanoate, 7-Hydroxyheptanoate, or 7-Oxoheptanoate as Central Precursors to Heptane-1,7-Diamine In some embodiments, heptane-1,7-diamine is synthesized from the central precursor, 7-aminoheptanoate, by conversion of 7-aminoheptanoate to 7-aminoheptanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 7-aminoheptanal to heptane-1,7-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 38.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

Figure 39:
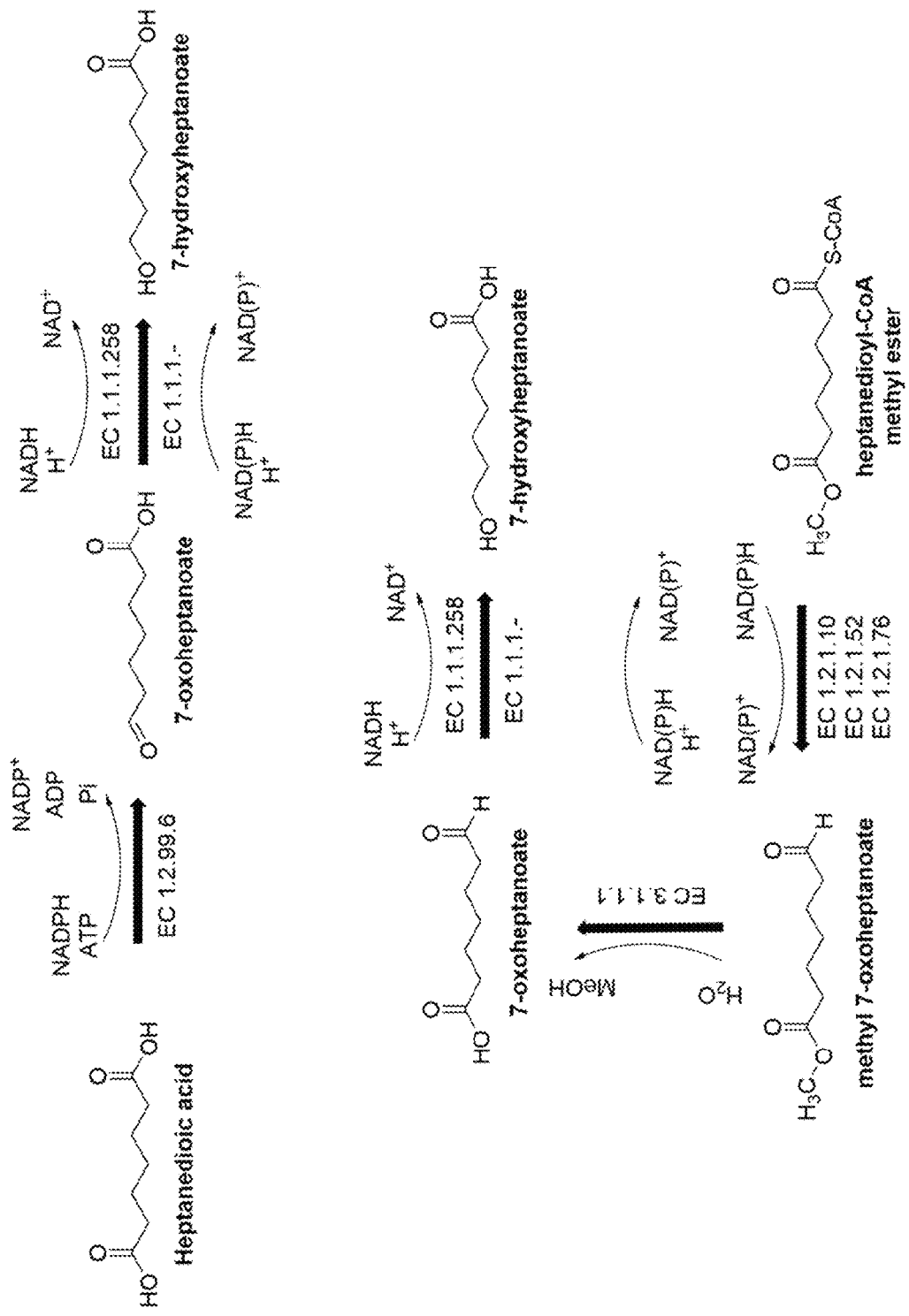
FIG. 39 is a schematic of exemplary biochemical pathways leading to 7-hydroxyheptanoate using heptanedioate, heptanedioyl-CoA methyl ester, methyl 7-oxoheptanoate, or 7-oxoheptanoate as central precursors.

In some embodiments, heptane-1,7-diamine is synthesized from the central precursor, 7-hydroxyheptanoate (which can be produced as described in FIG. 39), by conversion of 7-hydroxyheptanoate to 7-hydroxyheptanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 7-hydroxyheptanal to 7-aminoheptanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 7-aminoheptanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to heptane-1,7-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 38.

In some embodiments, heptane-1,7-diamine is synthesized from the central precursor, 7-aminoheptanoate, by conversion of 7-aminoheptanoate to N7-acetyl-7-aminoheptanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N7-acetyl-7-aminoheptanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N7-acetyl-1,7-diaminoheptane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to heptane-1,7-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45). See FIG. 38.

In some embodiments, heptane-1,7-diamine is synthesized from the central precursor, 7-oxoheptanoate, by conversion of 7-oxoheptanoate to 1,7-heptanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 7-aminoheptanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to heptane-1,7-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181. See FIG. 38.

Pathways Using Heptanedioic Acid or Heptanedioyl-CoA Methyl Ester as a Central Precursor to 7-Hydroxyheptanoate In some embodiments, 7-hydroxyheptanoate is synthesized from the central precursor, heptanedioic acid, by conversion of heptanedioic acid to 7-oxoheptanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 7-hydroxyheptanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23). See FIG. 39.

In some embodiments, 7-hydroxyheptanoate is synthesized from the central precursor, heptanedioyl-CoA methyl ester, by conversion of heptanedioyl-CoA methyl ester to methyl 7-oxoheptanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 7-oxoheptanoate to 7-oxoheptanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 7-hydroxyheptanoate by a polypeptide having the activity of a dehydrogenase classified, for example, under EC 1.1.1.- such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23). See FIG. 39.

Pathways Using 7-Hydroxyheptanoate as a Central Precursor to 1,7-Heptanediol

Figure 40:
FIG. 40 is a schematic of an exemplary biochemical pathway leading to 1,7-heptanediol using 7-hydroxyheptanoate as a central precursor.

In some embodiments, 1,7-heptanediol is synthesized from the central precursor, 7-hydroxyheptanoate, by conversion of 7-hydroxyheptanoate to 7-hydroxyheptanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 7-hydroxyheptanal to 1,7-heptanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23). See FIG. 40.

Pathways Using 7-Aminoheptanoate as a Central Precursor to 7-Aminoheptanol

In some embodiments, 7-aminoheptanol is synthesized from the central precursor, 7-aminoheptanoate, by conversion of 7-aminoheptanoate to 7-aminoheptanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 7-aminoheptanal to 7-aminoheptanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23). See FIG. 38.

$C_9$ Biochemical Pathways

Pathways Using NADPH-Specific Enzymes to Produce Nonanedioyl-[Acp] Methyl Ester as a Central Precursor Leading to $C_9$ Building Blocks In some embodiments, nonanedioyl-[acp] methyl ester is synthesized from the central metabolite propanedioyl-[acp] via three cycles of methyl-ester shielded carbon chain elongation by conversion of propanedioyl-[acp] to heptanedioyl-[acp] methyl ester as described above; followed by conversion to 3-oxo-nonanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-nonanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydrononanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to nonanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Nonanedioyl-CoA Methyl Ester as a Central Precursor Leading to C$_9$ Building Blocks In some embodiments, nonanedioyl-CoA methyl ester is synthesized from the central metabolite propanedioyl-CoA via three cycles of methyl-ester shielded carbon chain elongation by conversion of propanedioyl-CoA to heptanedioyl-CoA methyl ester as described above; followed by conversion to 3-oxo-nonanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-nonanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydrononanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to nonanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7).

Pathways Using NADH-Specific Enzymes to Produce Nonanedioyl-CoA Methyl Ester as a Central Precursor Leading to C$_9$ Building Blocks In some embodiments, nonanedioyl-CoA methyl ester is synthesized from the central metabolite propanedioyl-CoA via three cycles of methyl-ester shielded carbon chain elongation by conversion of propanedioyl-CoA to heptanedioyl-CoA methyl ester as described above; followed by conversion to 3-oxo-nonanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a f-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-nonanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydrononanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to nonanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Nonanedioyl-CoA Methyl Ester or Nonanedioyl-[Acp] Methyl Ester as Central Precursors to Nonanedioic Acid In some embodiments, nonanedioic acid is synthesized from the central precursor, nonanedioyl-[acp] methyl ester, by conversion of nonanedioyl-[acp] methyl ester to monomethyl nonanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to nonanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonanedioic acid is synthesized from the central precursor, nonanedioyl-CoA methyl ester, by conversion of nonanedioyl-CoA methyl ester to monomethyl nonanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to nonanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonanedioic acid is synthesized from the central precursor, nonanedioyl-CoA methyl ester, by conversion of nonanedioyl-CoA methyl ester to monomethyl nonanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to nonanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonanedioic acid is synthesized from the central precursor, nonanedioyl-CoA methyl ester, by conversion of nonanedioyl-CoA methyl ester to methyl 9-oxononanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl nonanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1. (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to nonanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonanedioic acid is synthesized from the central precursor, methyl 9-oxononanoate, by conversion of methyl 9-oxononanoate to monomethyl nonanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1. (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to nonanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Nonanedioyl-CoA Methyl Ester or Methyl 9-Oxononanoate as a Central Precursor to 9-Aminononanoate In some embodiments, 9-aminononanoate is synthesized from the central precursor, nonanedioyl-CoA methyl ester, by conversion of nonanedioyl-CoA methyl ester to methyl 9-oxononanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 9-oxononanoate to monomethyl 9-aminononanoate by a polypeptide having the activity of an aminotransferase classified, for example, under E EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 9-aminononanoate to 9-aminononanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 9-aminononanoate is synthesized from the central precursor, methyl 9-oxononanoate, by conversion of methyl 9-oxononanoate to monomethyl 9-aminononanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 9-aminononanoate to 9-aminononanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 9-aminononanoate is synthesized from the central precursor, monomethyl nonanedioate, by conversion of monomethyl nonanedioate to methyl 9-oxononanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 9-oxononanoate to monomethyl 9-aminononanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 9-aminononanoate to 9-aminononanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 9-aminononanoate is synthesized from the central precursor, nonanedioic acid, by conversion of nonanedioic acid to 9-oxononanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 9-oxononanoate to 9-aminononanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 9-Aminononanoate, 9-Hydroxynonanoate, or 9-Oxononanoate as Central Precursors to Nonane-1,9-Diamine In some embodiments, nonane-1,9-diamine is synthesized from the central precursor, 9-aminononanoate, by conversion of 9-aminononanoate to 9-aminononanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 9-aminononanal to nonane-1,9-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, nonane-1,9-diamine is synthesized from the central precursor, 9-hydroxynonanoate, by conversion of 9-hydroxynonanoate to 9-hydroxynonanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 9-hydroxynonanal to 9-aminononanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 9-aminononanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to nonane-1,9-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, nonane-1,9-diamine is synthesized from the central precursor, 9-aminononanoate, by conversion of 9-aminononanoate to N9-acetyl-9-aminononanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N9-acetyl-9-aminononanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N9-acetyl-1,9-diaminononane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to nonane-1,9-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, nonane-1,9-diamine is synthesized from the central precursor, 9-oxononanoate, by conversion of 9-oxononanoate to 1,9-nonanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 9-aminononanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to nonane-1,9-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Nonanedioic Acid or Nonanedioyl-CoA Methyl Ester as a Central Precursor to 9-Hydroxynonanoate In some embodiments, 9-hydroxynonanoate is synthesized from the central precursor, nonanedioic acid, by conversion of nonanedioic acid to 9-oxononanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 9-hydroxynonanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 9-hydroxynonanoate is synthesized from the central precursor, nonanedioyl-CoA methyl ester, by conversion of nonanedioyl-CoA methyl ester to methyl 9-oxononanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 9-oxononanoate to 9-oxononanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 9-hydroxynonanoate by a polypeptide having the activity of a dehydrogenase classified, for example, under EC 1.1.1.- such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 9-Hydroxynonanoate as a Central Precursor to 1,9-Nonanediol

In some embodiments, 1,9-nonanediol is synthesized from the central precursor, 9-hydroxynonanoate, by conversion of 9-hydroxynonanoate to 9-hydroxynonanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 9-hydroxynonanal to 1,9-nonanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 9-Aminononanoate as a Central Precursor to 9-Aminononanol

In some embodiments, 9-aminononanol is synthesized from the central precursor, 9-aminononanoate, by conversion of 9-aminononanoate to 9-aminononanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 9-aminononanal to 9-aminononanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_{11}$ Biochemical Pathways

Pathways Using NADPH-Specific Enzymes to Produce Undecanedioyl-[Acp] Methyl Ester as a Central Precursor Leading to $C_{11}$ Building Blocks In some embodiments, undecanedioyl-[acp] methyl ester is synthesized from the central metabolite propanedioyl-[acp] via four cycles of methyl-ester shielded carbon chain elongation by conversion of propanedioyl-[acp] to nonanedioyl-[acp] methyl ester as described above; followed by conversion to 3-oxo-undecanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-undecanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydroundecanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to undecanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Undecanedioyl-CoA Methyl Ester as a Central Precursor Leading to $C_{11}$ Building Blocks In some embodiments, undecanedioyl-CoA methyl ester is synthesized from the central metabolite propanedioyl-CoA via four cycles of methyl-ester shielded carbon chain elongation by conversion of propanedioyl-CoA to nonanedioyl-CoA methyl ester as described above; followed by conversion to 3-oxo-undecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a f-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-undecanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydroundecanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to undecanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7).

Pathways Using NADH-Specific Enzymes to Produce Undecanedioyl-CoA Methyl Ester as a Central Precursor Leading to $C_{11}$ Building Blocks In some embodiments, undecanedioyl-CoA methyl ester is synthesized from the central metabolite propanedioyl-CoA via four cycles of methyl-ester shielded carbon chain elongation by conversion of propanedioyl-CoA to nonanedioyl-CoA methyl ester as described above; followed by conversion to 3-oxo-undecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-undecanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydroundecanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to undecanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Undecanedioyl-CoA Methyl Ester or Undecanedioyl-[Acp] Methyl Ester as Central Precursors to Undecanedioic Acid In some embodiments, undecanedioic acid is synthesized from the central precursor, undecanedioyl-[acp] methyl ester, by conversion of undecanedioyl-[acp] methyl ester to monomethyl undecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to undecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, undecanedioic acid is synthesized from the central precursor, undecanedioyl-CoA methyl ester, by conversion of undecanedioyl-CoA methyl ester to monomethyl undecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to undecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, undecanedioic acid is synthesized from the central precursor, undecanedioyl-CoA methyl ester, by conversion of undecanedioyl-CoA methyl ester to monomethyl undecanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to undecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, undecanedioic acid is synthesized from the central precursor, undecanedioyl-CoA methyl ester, by conversion of undecanedioyl-CoA methyl ester to methyl 11-oxoundecanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl undecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to undecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, undecanedioic acid is synthesized from the central precursor, methyl 11-oxoundecanoate, by conversion of methyl 11-oxoundecanoate to monomethyl undecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to undecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Undecanedioyl-CoA Methyl Ester or Methyl 11-Oxoundecanoate as a Central Precursor to 11-Aminoundecanoate In some embodiments, 11-aminoundecanoate is synthesized from the central precursor, undecanedioyl-CoA methyl ester, by conversion of undecanedioyl-CoA methyl ester to methyl 11-oxoundecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 11-oxoundecanoate to monomethyl 11-aminoundecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 11-aminoundecanoate to 11-aminoundecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 11-aminoundecanoate is synthesized from the central precursor, methyl 11-oxoundecanoate, by conversion of methyl 11-oxoundecanoate to monomethyl 11-aminoundecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 11-aminoundecanoate to 11-aminoundecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 11-aminoundecanoate is synthesized from the central precursor, monomethyl undecanedioate, by conversion of monomethyl undecanedioate to methyl 11-oxoundecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 11-oxoundecanoate to monomethyl 11-aminoundecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 11-aminoundecanoate to 11-aminoundecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 11-aminoundecanoate is synthesized from the central precursor, undecanedioic acid, by conversion of undecanedioic acid to 11-oxoundecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 11-oxoundecanoate to 11-aminoundecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 11-Aminoundecanoate, 11-Hydroxyundecanoate, or 11-Oxoundecanoate as Central Precursors to Undecane-1,11-Diamine In some embodiments, undecane-1,11-diamine is synthesized from the central precursor, 11-aminoundecanoate, by conversion of 11-aminoundecanoate to 11-aminoundecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 11-aminoundecanal to undecane-1,11-diamine by a polypeptide having the activity of an aminotransferase classified, for example, under E EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, undecane-1,11-diamine is synthesized from the central precursor, 11-hydroxyundecanoate, by conversion of 11-hydroxyundecanoate to 11-hydroxyundecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 11-hydroxyundecanal to 11-aminoundecanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 11-aminoundecanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to undecane-1,11-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, undecane-1,11-diamine is synthesized from the central precursor, 11-aminoundecanoate, by conversion of 11-aminoundecanoate to N11-acetyl-11-aminoundecanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N11-acetyl-11-aminoundecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N11-acetyl-1,11-diaminoundecane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to undecane-1,11-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, undecane-1,11-diamine is synthesized from the central precursor, 11-oxoundecanoate, by conversion of 11-oxoundecanoate to 1,11-undecanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 11-aminoundecanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to undecane-1,11-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Undecanedioic Acid or Undecanedioyl-CoA Methyl Ester as a Central Precursor to 11-Hydroxyundecanoate In some embodiments, 11-hydroxyundecanoate is synthesized from the central precursor, undecanedioic acid, by conversion of undecanedioic acid to 11-oxoundecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 11-hydroxyundecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 11-hydroxyundecanoate is synthesized from the central precursor, undecanedioyl-CoA methyl ester, by conversion of undecanedioyl-CoA methyl ester to methyl 11-oxoundecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 11-oxoundecanoate to 11-oxoundecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 11-hydroxyundecanoate by a polypeptide having the activity of a dehydrogenase classified, for example, under EC 1.1.1.- such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 11-Hydroxyundecanoate as a Central Precursor to 1,11-Undecanediol In some embodiments, 1,11-undecanediol is synthesized from the central precursor, 11-hydroxyundecanoate, by conversion of 11-hydroxyundecanoate to 11-hydroxyundecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 11-hydroxyundecanal to 1,11-undecanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 11-Aminoundecanoate as a Central Precursor to 11-Aminoundecanol

In some embodiments, 11-aminoundecanol is synthesized from the central precursor, 11-aminoundecanoate, by conversion of 11-aminoundecanoate to 11-aminoundecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 11-aminoundecanal to 11-aminoundecanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_{13}$ Biochemical Pathways

Pathways Using NADPH-Specific Enzymes to Produce Tridecanedioyl-[Acp] Methyl Ester as a Central Precursor Leading to $C_{13}$ Building Blocks In some embodiments, tridecanedioyl-[acp] methyl ester is synthesized from the central metabolite propanedioyl-[acp] via five cycles of methyl-ester shielded carbon chain elongation by conversion of propanedioyl-[acp] to undecanedioyl-[acp] methyl ester as described above; followed by conversion to 3-oxo-tridecanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-tridecanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydrotridecanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to tridecanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Tridecanedioyl-CoA Methyl Ester as a Central Precursor Leading to $C_{13}$ Building Blocks In some embodiments, tridecanedioyl-CoA methyl ester is synthesized from the central metabolite propanedioyl-CoA via five cycles of methyl-ester shielded carbon chain elongation by conversion of propanedioyl-CoA to undecanedioyl-CoA methyl ester as described above; followed by conversion to 3-oxo-tridecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-tridecanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydrotridecanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to tridecanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 114 or SEQ ID NO: 115).

Pathways Using NADH-Specific Enzymes to Produce Tridecanedioyl-CoA Methyl Ester as a Central Precursor Leading to C13 Building Blocks In some embodiments, tridecanedioyl-CoA methyl ester is synthesized from the central metabolite propanedioyl-CoA via five cycles of methyl-ester shielded carbon chain elongation by conversion of propanedioyl-CoA to undecanedioyl-CoA methyl ester as described above; followed by conversion to 3-oxo-tridecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-tridecanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydrotridecanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to tridecanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Tridecanedioyl-CoA Methyl Ester or Tridecanedioyl-[Acp] Methyl Ester as Central Precursors to Tridecanedioic Acid In some embodiments, tridecanedioic acid is synthesized from the central precursor, tridecanedioyl-[acp] methyl ester, by conversion of tridecanedioyl-[acp] methyl ester to monomethyl tridecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to tridecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, tridecanedioic acid is synthesized from the central precursor, tridecanedioyl-CoA methyl ester, by conversion of tridecanedioyl-CoA methyl ester to monomethyl tridecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to tridecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, tridecanedioic acid is synthesized from the central precursor, tridecanedioyl-CoA methyl ester, by conversion of tridecanedioyl-CoA methyl ester to monomethyl tridecanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to tridecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, tridecanedioic acid is synthesized from the central precursor, tridecanedioyl-CoA methyl ester, by conversion of tridecanedioyl-CoA methyl ester to methyl 13-oxotridecanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl tridecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxo-heptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO:

10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to tridecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, tridecanedioic acid is synthesized from the central precursor, methyl 13-oxotridecanoate, by conversion of methyl 13-oxotridecanoate to monomethyl tridecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to tridecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Tridecanedioyl-CoA Methyl Ester or Methyl 13-Oxotridecanoate as a Central Precursor to 13-Aminotridecanoate In some embodiments, 13-aminotridecanoate is synthesized from the central precursor, tridecanedioyl-CoA methyl ester, by conversion of tridecanedioyl-CoA methyl ester to methyl 13-oxotridecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 13-oxotridecanoate to monomethyl 13-aminotridecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 13-aminotridecanoate to 13-aminotridecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 13-aminotridecanoate is synthesized from the central precursor, methyl 13-oxotridecanoate, by conversion of methyl 13-oxotridecanoate to monomethyl 13-aminotridecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 13-aminotridecanoate to 13-aminotridecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 13-aminotridecanoate is synthesized from the central precursor, monomethyl tridecanedioate, by conversion of monomethyl tridecanedioate to methyl 13-oxotridecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 13-oxotridecanoate to monomethyl 13-aminotridecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 13-aminotridecanoate to 13-aminotridecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 13-aminotridecanoate is synthesized from the central precursor, tridecanedioic acid, by conversion of tridecanedioic acid to 13-oxotridecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 13-oxotridecanoate to 13-aminotridecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 13-Aminotridecanoate, 13-Hydroxytridecanoate, or 13-Oxotridecanoate as Central Precursors to Tridecane-1,13-Diamine In some embodiments, tridecane-1,13-diamine is synthesized from the central precursor, 13-aminotridecanoate, by conversion of 13-aminotridecanoate to 13-aminotridecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 13-aminotridecanal to tridecane-1,13-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, tridecane-1,13-diamine is synthesized from the central precursor, 13-hydroxytridecanoate, by conversion of 13-hydroxytridecanoate to 13-hydroxytridecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 13-hydroxytridecanal to 13-aminotridecanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 13-aminotridecanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to tridecane-1,13-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, tridecane-1,13-diamine is synthesized from the central precursor, 13-aminotridecanoate, by conversion of 13-aminotridecanoate to N13-acetyl-13-aminotridecanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N13-acetyl-13-aminotridecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N13-acetyl-1,13-diaminotridecane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to tridecane-1,13-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, tridecane-1,13-diamine is synthesized from the central precursor, 13-oxotridecanoate, by conversion of 13-oxotridecanoate to 1,13-tridecanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 13-aminotridecanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to tridecane-1,13-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Tridecanedioic Acid or Tridecanedioyl-CoA Methyl Ester as a Central Precursor to 13-Hydroxytridecanoate In some embodiments, 13-hydroxytridecanoate is synthesized from the central precursor, tridecanedioic acid, by conversion of tridecanedioic acid to 13-oxotridecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 13-hydroxytridecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 13-hydroxytridecanoate is synthesized from the central precursor, tridecanedioyl-CoA methyl ester, by conversion of tridecanedioyl-CoA methyl ester to methyl 13-oxotridecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 13-oxotridecanoate to 13-oxotridecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 13-hydroxytridecanoate by a polypeptide having the activity of a dehydrogenase classified, for example, under EC 1.1.1.- such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 13-Hydroxytridecanoate as a Central Precursor to 1,13-Tridecanediol In some embodiments, 1,13-tridecanediol is synthesized from the central precursor, 13-hydroxytridecanoate, by conversion of 13-hydroxytridecanoate to 13-hydroxytridecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 13-hydroxytridecanal to 1,13-tridecanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 13-Aminotridecanoate as a Central Precursor to 13-Aminotridecanol In some embodiments, 13-aminotridecanol is synthesized from the central precursor, 13-aminotridecanoate, by conversion of 13-aminotridecanoate to 13-aminotridecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 13-aminotridecanal to 13-aminotridecanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_{15}$ Biochemical Pathways

Pathways Using NADPH-Specific Enzymes to Produce Pentadecanedioyl-[Acp] Methyl Ester as a Central Precursor Leading to $C_{15}$ Building Blocks In some embodiments, pentadecanedioyl-[acp] methyl ester is synthesized from the central metabolite propanedioyl-[acp] via six cycles of methyl-ester shielded carbon chain elongation by conversion of propanedioyl-[acp] to tridecanedioyl-[acp] methyl ester as described above; followed by conversion to 3-oxo-pentadecanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-pentadecanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydropentadecanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to pentadecanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Pentadecanedioyl-CoA Methyl Ester as a Central Precursor Leading to $C_{15}$ Building Blocks In some embodiments, pentadecanedioyl-CoA methyl ester is synthesized from the central metabolite propanedioyl-CoA via six cycles of methyl-ester shielded carbon chain elongation by conversion of propanedioyl-CoA to tridecanedioyl-CoA methyl ester as described above; followed by conversion to 3-oxo-pentadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-pentadecanedioyl-CoA methyl ester by a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydropentadecanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to pentadecanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7).

Pathways Using NADH-Specific Enzymes to Produce Pentadecanedioyl-CoA Methyl Ester as a Central Precursor Leading to $C_{15}$ Building Blocks In some embodiments, pentadecanedioyl-CoA methyl ester is synthesized from the central metabolite propanedioyl-CoA via six cycles of methyl-ester shielded carbon chain elongation by conversion of propanedioyl-CoA to tridecanedioyl-CoA methyl ester as described above; followed by conversion to 3-oxo-pentadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-pentadecanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydropentadecanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to pentadecanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Pentadecanedioyl-CoA Methyl Ester or Pentadecanedioyl-[Acp] Methyl Ester as Central Precursors to Pentadecanedioic Acid In some embodiments, pentadecanedioic acid is synthesized from the central precursor, pentadecanedioyl-[acp] methyl ester, by conversion of pentadecanedioyl-[acp] methyl ester to monomethyl pentadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to pentadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentadecanedioic acid is synthesized from the central precursor, pentadecanedioyl-CoA methyl ester, by conversion of pentadecanedioyl-CoA methyl ester to monomethyl pentadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to pentadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentadecanedioic acid is synthesized from the central precursor, pentadecanedioyl-CoA methyl ester, by conversion of pentadecanedioyl-CoA methyl ester to monomethyl pentadecanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to pentadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, pentadecanedioic acid is synthesized from the central precursor, pentadecanedioyl-CoA methyl ester, by conversion of pentadecanedioyl-CoA methyl ester to methyl 15-oxopentadecanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl pentadecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to pentadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Pentadecanedioyl-CoA Methyl Ester or Methyl 15-Oxopentadecanoate as a Central Precursor to 15-Aminopentadecanoate In some embodiments, 15-aminopentadecanoate is synthesized from the central precursor, pentadecanedioyl-CoA methyl ester, by conversion of pentadecanedioyl-CoA methyl ester to methyl 15-oxopentadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 15-oxopentadecanoate to monomethyl 15-aminopentadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 15-aminopentadecanoate to 15-aminopentadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 15-aminopentadecanoate is synthesized from the central precursor, methyl 15-oxopentadecanoate, by conversion of methyl 15-oxopentadecanoate to monomethyl 15-aminopentadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 15-aminopentadecanoate to 15-aminopentadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 15-aminopentadecanoate is synthesized from the central precursor, monomethyl pentadecanedioate, by conversion of monomethyl pentadecanedioate to methyl 15-oxopentadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 15-oxopentadecanoate to monomethyl 15-aminopentadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 15-aminopentadecanoate to 15-aminopentadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 15-aminopentadecanoate is synthesized from the central precursor, pentadecanedioic acid, by conversion of pentadecanedioic acid to 15-oxopentadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 15-oxopentadecanoate to 15-aminopentadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 15-Aminopentadecanoate, 15-Hydroxypentadecanoate, or 15-Oxopentadecanoate as Central Precursors to Pentadecane-1,15-Diamine In some embodiments, pentadecane-1,15-diamine is synthesized from the central precursor, 15-aminopentadecanoate, by conversion of 15-aminopentadecanoate to 15-aminopentadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 15-aminopentadecanal to pentadecane-1,15-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional $C_4$ and $C_5$ carboxylic acids (Venkitasubramanian et al., *Enzyme and Microbial Technology*, 2008, 42, 130-137).

In some embodiments, pentadecane-1,15-diamine is synthesized from the central precursor, 15-hydroxypentadecanoate, by conversion of 15-hydroxypentadecanoate to 15-hydroxypentadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 15-hydroxypentadecanal to 15-aminopentadecanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 15-aminopentadecanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to pentadecane-1,15-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, pentadecane-1,15-diamine is synthesized from the central precursor, 15-aminopentadecanoate, by conversion of 15-aminopentadecanoate to N15-acetyl-15-aminopentadecanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N15-acetyl-15-aminopentadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N15-acetyl-1,15-diaminopentadecane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to pentadecane-1,15-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, pentadecane-1,15-diamine is synthesized from the central precursor, 15-oxopentadecanoate, by conversion of 15-oxopentadecanoate to 1,15-pentadecanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 15-aminopentadecanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to pentadecane-1,15-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Pentadecanedioic Acid or Pentadecanedioyl-CoA Methyl Ester as a Central Precursor to 15-Hydroxypentadecanoate In some embodiments, 15-hydroxypentadecanoate is synthesized from the central precursor, pentadecanedioic acid, by conversion of pentadecanedioic acid to 15-oxopentadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 15-hydroxypentadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 15-hydroxypentadecanoate is synthesized from the central precursor, pentadecanedioyl-CoA methyl ester, by conversion of pentadecanedioyl-CoA methyl ester to methyl 15-oxopentadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 15-oxopentadecanoate to 15-oxopentadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 15-hydroxypentadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 15-Hydroxypentadecanoate as a Central Precursor to 1,15-Pentadecanediol In some embodiments, 1,15-pentadecanediol is synthesized from the central precursor, 15-hydroxypentadecanoate, by conversion of 15-hydroxypentadecanoate to 15-hydroxypentadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 15-hydroxypentadecanal to 1,15-pentadecanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 15-Aminopentadecanoate as a Central Precursor to 15-Aminopentadecanol In some embodiments, 15-aminopentadecanol is synthesized from the central precursor, 15-aminopentadecanoate, by conversion of 15-aminopentadecanoate to 15-aminopentadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 15-aminopentadecanal to 15-aminopentadecanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_{17}$ Biochemical Pathways

Pathways Using NADPH-Specific Enzymes to Produce Heptadecanedioyl-[Acp] Methyl Ester as a Central Precursor Leading to $C_{17}$ Building Blocks In some embodiments, heptadecanedioyl-[acp] methyl ester is synthesized from the central metabolite propanedioyl-[acp] via seven cycles of methyl-ester shielded carbon chain elongation by conversion of propanedioyl-[acp] to pentadecanedioyl-[acp] methyl ester as described above; followed by conversion to 3-oxo-heptadecanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-heptadecanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydro-heptadecanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to heptadecanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Heptadecanedioyl-CoA Methyl Ester as a Central Precursor Leading to $C_{17}$ Building Blocks In some embodiments, heptadecanedioyl-CoA methyl ester is synthesized from the central metabolite propanedioyl-CoA via seven cycles of methyl-ester shielded carbon chain elongation by conversion of propanedioyl-CoA to pentadecanedioyl-CoA methyl ester as described above; followed by conversion to 3-oxo-heptadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-heptadecanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydroheptadecanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to heptadecanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7).

Pathways Using NADH-Specific Enzymes to Produce Heptadecanedioyl-CoA Methyl Ester as a Central Precursor Leading to $C_{17}$ Building Blocks In some embodiments, heptadecanedioyl-CoA methyl ester is synthesized from the central metabolite propanedioyl-CoA via seven cycles of methyl-ester shielded carbon chain elongation by conversion of propanedioyl-CoA to pentadecanedioyl-CoA methyl ester as described above;

followed by conversion to 3-oxo-heptadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a β-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-heptadecanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydroheptadecanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to heptadecanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Heptadecanedioyl-CoA Methyl Ester or Heptadecanedioyl-[Acp] Methyl Ester as Central Precursors to Heptadecanedioic Acid In some embodiments, heptadecanedioic acid is synthesized from the central precursor, heptadecanedioyl-[acp] methyl ester, by conversion of heptadecanedioyl-[acp] methyl ester to monomethyl heptadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to heptadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, heptadecanedioic acid is synthesized from the central precursor, heptadecanedioyl-CoA methyl ester, by conversion of heptadecanedioyl-CoA methyl ester to monomethyl heptadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to heptadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, heptadecanedioic acid is synthesized from the central precursor, heptadecanedioyl-CoA methyl ester, by conversion of heptadecanedioyl-CoA methyl ester to monomethyl heptadecanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to heptadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, heptadecanedioic acid is synthesized from the central precursor, heptadecanedioyl-CoA methyl ester, by conversion of heptadecanedioyl-CoA methyl ester to methyl 17-oxoheptadecanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl heptadecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to heptadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, heptadecanedioic acid is synthesized from the central precursor, methyl 17-oxoheptadecanoate, by conversion of methyl 17-oxoheptadecanoate to monomethyl heptadecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to heptadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Heptadecanedioyl-CoA Methyl Ester or Methyl 17-Oxoheptadecanoate as a Central Precursor to 17-Aminoheptadecanoate In some embodiments, 17-aminoheptadecanoate is synthesized from the central precursor, heptadecanedioyl-CoA methyl ester, by conversion of heptadecanedioyl-CoA methyl ester to methyl 17-oxoheptadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 17-oxoheptadecanoate to monomethyl 17-aminoheptadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 17-aminoheptadecanoate to 17-aminoheptadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 17-aminoheptadecanoate is synthesized from the central precursor, methyl 17-oxoheptadecanoate, by conversion of methyl 17-oxoheptadecanoate to monomethyl 17-aminoheptadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 17-aminoheptadecanoate to 17-aminoheptadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 17-aminoheptadecanoate is synthesized from the central precursor, monomethyl heptadecanedioate, by conversion of monomethyl heptadecanedioate to methyl 17-oxoheptadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 17-oxoheptadecanoate to monomethyl 17-aminoheptadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 17-aminoheptadecanoate to 17-aminoheptadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 17-aminoheptadecanoate is synthesized from the central precursor, heptadecanedioic acid, by conversion of heptadecanedioic acid to 17-oxoheptadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 17-oxoheptadecanoate to 17-aminoheptadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 17-Aminoheptadecanoate, 17-Hydroxyheptadecanoate, or 17-Oxoheptadecanoate as Central Precursors to Heptadecane-1,17-Diamine In some embodiments, heptadecane-1,17-diamine is synthesized from the central precursor, 17-aminoheptadecanoate, by conversion of 17-aminoheptadecanoate to 17-aminoheptadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7

(e.g., a polypeptide having at least 50%, at least 60%, at least 70%, or at least 85% sequence homology to the amino acid sequence of any one of SEQ ID NOs: 54-57); followed by conversion of 17-aminoheptadecanal to heptadecane-1,17-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional $C_4$ and $C_5$ carboxylic acids (Venkitasubramanian et al., *Enzyme and Microbial Technology*, 2008, 42, 130-137).

In some embodiments, heptadecane-1,17-diamine is synthesized from the central precursor, 17-hydroxyheptadecanoate, by conversion of 17-hydroxyheptadecanoate to 17-hydroxyheptadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 17-hydroxyheptadecanal to 17-aminoheptadecanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 17-aminoheptadecanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to heptadecane-1,17-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, heptadecane-1,17-diamine is synthesized from the central precursor, 17-aminoheptadecanoate, by conversion of 17-aminoheptadecanoate to N17-acetyl-17-aminoheptadecanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N17-acetyl-17-aminoheptadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to N17-acetyl-1,17-diaminoheptadecane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to heptadecane-1,17-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, heptadecane-1,17-diamine is synthesized from the central precursor, 17-oxoheptadecanoate, by conversion of 17-oxoheptadecanoate to 1,17-heptadecanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 17-aminoheptadecanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to heptadecane-1,17-diamine by a polypeptide having the activity of an aminotransferase classified, for example, underEC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Heptadecanedioic Acid or Heptadecanedioyl-CoA Methyl Ester as a Central Precursor to 17-Hydroxyheptadecanoate In some embodiments, 17-hydroxyheptadecanoate is synthesized from the central precursor, heptadecanedioic acid, by conversion of heptadecanedioic acid to 17-oxoheptadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 17-hydroxyheptadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 17-hydroxyheptadecanoate is synthesized from the central precursor, heptadecanedioyl-CoA methyl ester, by conversion of heptadecanedioyl-CoA methyl ester to methyl 17-oxoheptadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 17-oxoheptadecanoate to 17-oxoheptadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 17-hydroxyheptadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 17-Hydroxyheptadecanoate as a Central Precursor to 1,17-Heptadecanediol In some embodiments, 1,17-heptadecanediol is synthesized from the central precursor, 17-hydroxyheptadecanoate, by conversion of 17-hydroxyheptadecanoate to 17-hydroxyheptadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 17-hydroxyheptadecanal to 1,17-heptadecanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 17-Aminoheptadecanoate as a Central Precursor to 17-Aminoheptadecanol In some embodiments, 17-aminoheptadecanol is synthesized from the central precursor, 17-aminoheptadecanoate, by conversion of 17-aminoheptadecanoate to 17-aminoheptadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 17-aminoheptadecanal to 17-aminoheptadecanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

$C_{19}$ Biochemical Pathways

Pathways Using NADPH-Specific Enzymes to Produce Nonadecanedioyl-[Acp] Methyl Ester as a Central Precursor Leading to $C_{19}$ Building Blocks In some embodiments, nonadecanedioyl-[acp] methyl ester is synthesized from the central metabolite propanedioyl-[acp] via eight cycles of methyl-ester shielded carbon chain elongation by conversion of propanedioyl-[acp] to heptadecanedioyl-[acp] methyl ester as described above; followed by conversion to 3-oxo-nonadecanedioyl-[acp] methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16); followed by conversion to 3-hydroxy-nonadecanedioyl-[acp] methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5); followed by conversion to 2,3-dehydrononadecanedioyl-[acp] methyl ester by a polypeptide having the activity of a 3-hydroxyacyl-[acp] dehydratase classified, for example, under EC 4.2.1.59 (e.g., a polypeptide having at least 50%, at least 60%, at least 70%, or at least 85% sequence homology to the amino acid sequence of SEQ ID NO: 1); followed by conversion to nonadecanedioyl-[acp] methyl ester by a polypeptide having the activity of an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6).

Pathways Using NADPH-Specific Enzymes to Produce Nonadecanedioyl-CoA Methyl Ester as a Central Precursor Leading to $C_{19}$ Building Blocks In some embodiments, nonadecanedioyl-CoA methyl ester is synthesized from the central metabolite propanedioyl-CoA via eight cycles of methyl-ester shielded carbon chain elongation by conversion of propanedioyl-CoA to heptadecanedioyl-CoA methyl ester as described above; followed by conversion to 3-oxo-nonadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16), or a f-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-nonadecanedioyl-CoA methyl ester by a polypeptide having the activity of a 3-oxoacyl-[acp] reductase classified, for example, under EC 1.1.1.100 (e.g., a polypeptide having at least 50%, at least 60%, at least 70%, or at least 85% sequence homology to the amino acid sequence of SEQ ID NO: 5), a polypeptide having the activity of a 3-hydroxyacyl-CoA dehydrogenase classified, for example, under EC 1.1.1.157 (e.g., a polypeptide having at least 50%, at least 60%, at least 70%, or at least 85% sequence homology to the amino acid sequence of SEQ ID NO: 4), or a polypeptide having the activity of an acetoacetyl-CoA reductase classified, for example, under EC 1.1.1.36 (e.g., a polypeptide having at least 50%, at least 60%, at least 70%, or at least 85% sequence homology to the amino acid sequence of SEQ ID NO: 3); followed by conversion to 2,3-dehydrononadecanedioyl-CoA methyl ester by a polypeptide having the activity of an enoyl-CoA hydratase classified, for example, under EC 4.2.1.119 (e.g., a polypeptide having at least 50%, at least 60%, at least 70%, or at least 85% sequence homology to the amino acid sequence of SEQ ID NO: 48); followed by conversion to nonadecanedioyl-CoA methyl ester by a polypeptide having the activity of a reductase classified, for example, under EC 1.3.1.-such as an enoyl-[acp] reductase classified, for example, under EC 1.3.1.10 (e.g., a polypeptide having at least 50%, at least 60%, at least 70%, or at least 85% sequence homology to the amino acid sequence of SEQ ID NO: 6) or a trans-2-enoyl-CoA reductase classified, for example, under EC 1.3.1.38 or EC 1.3.1.8 (e.g., a polypeptide having at least 50%, at least 60%, at least 70%, or at least 85% sequence homology to the amino acid sequence of SEQ ID NO: 7).

Pathways Using NADH-Specific Enzymes to Produce Nonadecanedioyl-CoA Methyl Ester as a Central Precursor Leading to $C_{19}$ Building Blocks In some embodiments, nonadecanedioyl-CoA methyl ester is synthesized from the central metabolite propanedioyl-CoA via eight cycles of methyl-ester shielded carbon chain elongation by conversion of propanedioyl-CoA to heptadecanedioyl-CoA methyl ester as described above; followed by conversion to 3-oxo-nonadecanedioyl-CoA methyl ester by a polypeptide having the activity of a β-ketoacyl-[acp] synthase classified, for example, under EC 2.3.1.- (e.g., EC 2.3.1.41 or EC 2.3.1.179) (e.g., a polypeptide having at least 50%, at least 60%, at least 70%, or at least 85% sequence homology to the amino acid sequence of any one of SEQ ID NOs: 14-16) or a f-ketothiolase classified, for example, under EC 2.3.1.16 (e.g., a polypeptide having at least 50%, at least 60%, at least 70%, or at least 85% sequence homology to the amino acid sequence of SEQ ID NO: 17); followed by conversion to 3-hydroxy-nonadecanedioyl-CoA methyl ester by a polypeptide having the activity of a 3-hydroxyacyl-CoA dehydrogenase classified, for example, under EC 1.1.1.35 (e.g., a polypeptide having at least 50%, at least 60%, at least 70%, or at least 85% sequence homology to the amino acid sequence of SEQ ID NO: 2); followed by conversion to 2,3-dehydrononadecanedioyl-CoA methyl ester by a polypeptide having the activity of an enoyl-CoA hydratase classified, for example, under EC 4.2.1.17 (e.g., a polypeptide having at least 50%, at least 60%, at least 70%, or at least 85% sequence homology to the amino acid sequence of SEQ ID NO: 47); followed by conversion to nonadecanedioyl-CoA methyl ester by a polypeptide having the activity of a trans-2-enoyl-CoA reductase classified, for example, under EC 1.3.1.44 (e.g., a polypeptide having at least 50%, at least 60%, at least 70%, or at least 85% sequence homology to the amino acid sequence of SEQ ID NO: 114 or SEQ ID NO: 115) or a polypeptide having the activity of an enoyl-[acp] reductase classified, for example, under EC 1.3.1.9 (e.g., a polypeptide having at least 50%, at least 60%, at least 70%, or at least 85% sequence homology to the amino acid sequence of SEQ ID NO: 46).

Pathways Using Nonadecanedioyl-CoA Methyl Ester or Nonadecanedioyl-[Acp] Methyl Ester as Central Precursors to Nonadecanedioic Acid In some embodiments, nonadecanedioic acid is synthesized from the central precursor, nonadecanedioyl-[acp] methyl ester, by conversion of nonadecanedioyl-[acp] methyl ester to monomethyl nonadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to nonadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonadecanedioic acid is synthesized from the central precursor, nonadecanedioyl-CoA methyl ester, by conversion of nonadecanedioyl-CoA methyl ester to monomethyl nonadecanedioate by a polypeptide having the activity of a thioesterase classified, for example, under EC 3.1.1.2, EC 3.1.1.5, or EC 3.1.2.-, such as EC 3.1.2.14, EC 3.1.2.21, or EC 3.1.2.27, or a polypeptide having at least 50%, at least 60%, at least 70%, or at least 85% sequence homology to the amino acid sequence of any one of SEQ ID NOs: 58-113 or SEQ ID NOs: 182-195; followed by conversion to nonadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonadecanedioic acid is synthesized from the central precursor, nonadecanedioyl-CoA methyl ester, by conversion of nonadecanedioyl-CoA methyl ester to monomethyl nonadecanedioate by a polypeptide having the activity of a CoA-transferase such as a glutaconate CoA-transferase classified, for example, under EC 2.8.3.12 (e.g., a polypeptide having at least 50%, at least 60%, at least 70%, or at least 85% sequence homology to the amino acid sequence of SEQ ID NO: 40 or SEQ ID NO: 41) or a CoA-ligase classified, for example, under EC 6.2.1.5; followed by conversion to nonadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonadecanedioic acid is synthesized from the central precursor, nonadecanedioyl-CoA methyl ester, by conversion of nonadecanedioyl-CoA methyl ester to methyl 19-oxononadecanoate by a polypeptide having the activity of an acetylating aldehyde dehydrogenase classified, for example, under EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion to monomethyl nonadecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to nonadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, nonadecanedioic acid is synthesized from the central precursor, methyl 19-oxononadecanoate, by conversion of methyl 19-oxononadecanoate to monomethyl nonadecanedioate by a polypeptide having the activity of a non-acylating NAD-dependent aldehyde dehydrogenase (e.g., a polypeptide having at least 50%, at least 60%, at least 70%, or at least 85% sequence homology to the amino acid sequence of SEQ ID NO: 11), a 7-oxoheptanoate dehydrogenase classified, for example, under EC 1.2.1.- (e.g., a polypeptide having at least 50%, at least 60%, at least 70%, or at least 85% sequence homology to the amino acid sequence of SEQ ID NO: 12 or SEQ ID NO: 13), a 6-oxohexanoate dehydrogenase classified, for example, under EC 1.2.1.- (e.g., a polypeptide having at least 50%, at least 60%, at least 70%, or at least 85% sequence homology to the amino acid sequence of SEQ ID NO: 9 or SEQ ID NO: 10), or an aldehyde dehydrogenase classified, for example, under EC 1.2.1.3 (e.g., a polypeptide having at least 50%, at least 60%, at least 70%, or at least 85% sequence homology to the amino acid sequence of SEQ ID NO: 24); followed by conversion to nonadecanedioic acid by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

Pathways Using Nonadecanedioyl-CoA Methyl Ester or Methyl 19-Oxononadecanoate as a Central Precursor to 19-Aminononadecanoate In some embodiments, 19-aminononadecanoate is synthesized from the central precursor, nonadecanedioyl-CoA methyl ester, by conversion of nonadecanedioyl-CoA methyl ester to methyl 19-oxononadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 19-oxononadecanoate to monomethyl 19-aminononadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 19-aminononadecanoate to 19-aminononadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 19-aminononadecanoate is synthesized from the central precursor, methyl 19-oxononadecanoate, by conversion of methyl 19-oxononadecanoate to monomethyl 19-aminononadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 19-aminononadecanoate to 19-aminononadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 19-aminononadecanoate is synthesized from the central precursor, monomethyl nonadecanedioate, by conversion of monomethyl nonadecanedioate to methyl 19-oxononadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of methyl 19-oxononadecanoate to monomethyl 19-aminononadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion of monomethyl 19-aminononadecanoate to 19-aminononadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51).

In some embodiments, 19-aminononadecanoate is synthesized from the central precursor, nonadecanedioic acid, by conversion of nonadecanedioic acid to 19-oxononadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 19-oxononadecanoate to 19-aminononadecanoate by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using 19-Aminononadecanoate, 19-Hydroxynonadecanoate, or 19-Oxononadecanoate as Central Precursors to Nonadecane-1,19-Diamine In some embodiments, nonadecane-1,19-diamine is synthesized from the central precursor, 19-aminononadecanoate, by conversion of 19-aminononadecanoate to 19-aminononadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 19-aminononadecanal to nonadecane-1,19-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

The carboxylate reductase encoded by the gene product of car and the phosphopantetheine transferase enhancer npt or sfp has broad substrate specificity, including terminal difunctional C4 and C5 carboxylic acids (Venkitasubramanian et al., *Enzyme and Microbial Technology*, 2008, 42, 130-137).

In some embodiments, nonadecane-1,19-diamine is synthesized from the central precursor, 19-hydroxynonadecanoate, by conversion of 19-hydroxynonadecanoate to 19-hydroxynonadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 19-hydroxynonadecanal to 19-aminononadecanol by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to 19-aminononadecanal by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23); followed by conversion to nonadecane-1,19-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

In some embodiments, nonadecane-1,19-diamine is synthesized from the central precursor, 19-aminononadecanoate, by conversion of 19-aminononadecanoate to N19-acetyl-19-aminononadecanoate by a polypeptide having the activity of an N-acetyltransferase such as a lysine N-acetyltransferase classified, for example, under EC 2.3.1.32 (e.g., a polypeptide having at least 50%, at least 60%, at least 70%, or at least 85% sequence homology to the amino acid sequence of SEQ ID NO: 53); followed by conversion to N19-acetyl-19-aminononadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57);

followed by conversion to N19-acetyl-1,19-diaminononadecane by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to nonadecane-1,19-diamine by a polypeptide having the activity of an acetylputrescine deacylase classified, for example, under EC 3.5.1.62 (e.g., a polypeptide having at least 50%, at least 60%, at least 70%, or at least 85% sequence homology to the amino acid sequence of any one of SEQ ID NOs: 42-45).

In some embodiments, nonadecane-1,19-diamine is synthesized from the central precursor, 19-oxononadecanoate, by conversion of 19-oxononadecanoate to 1,19-nonadecanedial by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 19-aminononadecanal by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181; followed by conversion to nonadecane-1,19-diamine by a polypeptide having the activity of an aminotransferase classified, for example, under EC 2.6.1.-, such as EC 2.6.1.11, EC 2.6.1.13, EC 2.6.1.18, EC 2.6.1.19, EC 2.6.1.29, EC 2.6.1.48, or EC 2.6.1.82, EC 4.1.1.64, or EC 5.4.3.8, or a polypeptide having at least 50%, at least 60%, at least 70%, or at least 85% sequence homology to the amino acid sequence of any one of SEQ ID NOs: 116-138 or SEQ ID NOs: 167-181.

Pathways Using Nonadecanedioic Acid or Nonadecanedioyl-CoA Methyl Ester as a Central Precursor to 19-Hydroxynonadecanoate In some embodiments, 19-hydroxynonadecanoate is synthesized from the central precursor, nonadecanedioic acid, by conversion of nonadecanedioic acid to 19-oxononadecanoate by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion to 19-hydroxynonadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

In some embodiments, 19-hydroxynonadecanoate is synthesized from the central precursor, nonadecanedioyl-CoA methyl ester, by conversion of nonadecanedioyl-CoA methyl ester to methyl 19-oxononadecanoate by a polypeptide having the activity of an acetylating aldehyde dehydrogenase classified, for example, EC 1.2.1.10 (e.g., a polypeptide having at least 50%, at least 60%, at least 70%, or at least 85% sequence homology to the amino acid sequence of SEQ ID NO: 18), a polypeptide having at least 50%, at least 60%, at least 70%, or at least 85% sequence homology to the amino acid sequence of SEQ ID NO: 19, a polypeptide having the activity of a succinate semialdehyde dehydrogenase classified, for example, under EC 1.2.1.76, or a polypeptide having the activity of an oxoglutarate dehydrogenase classified, for example, under EC 1.2.1.52; followed by conversion of methyl 19-oxononadecanoate to 19-oxononadecanoate by a polypeptide having the activity of an esterase classified, for example, under EC 3.1.1.1 (e.g., a polypeptide having at least 50%, at least 60%, at least 70%, or at least 85% sequence homology to the amino acid sequence of SEQ ID NO: 50 or SEQ ID NO: 51); followed by conversion to 19-hydroxynonadecanoate by a polypeptide having the activity of a dehydrogenase classified, for example, under EC 1.1.1.-such as a 6-hydroxyhexanoate dehydrogenase classified, for example, under EC 1.1.1.258 (e.g., a polypeptide having at least 50%, at least 60%, at least 70%, or at least 85% sequence homology to the amino acid sequence of SEQ ID NO: 8), a polypeptide having the activity of a 5-hydroxypentanoate dehydrogenase classified, for example, under EC 1.1.1.- (e.g., a polypeptide having at least 50%, at least 60%, at least 70%, or at least 85% sequence homology to the amino acid sequence of SEQ ID NO: 21), or a polypeptide having the activity of a 4-hydroxybutyrate dehydrogenase (e.g., a polypeptide having at least 50%, at least 60%, at least 70%, or at least 85% sequence homology to the amino acid sequence of SEQ ID NO: 23).

Pathways Using 19-Hydroxynonadecanoate as a Central Precursor to 1,19-Nonadecanediol In some embodiments, 1,19-nonadecanediol is synthesized from the central precursor, 19-hydroxynonadecanoate, by conversion of 19-hydroxynonadecanoate to 19-hydroxynonadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 19-hydroxynonadecanal to 1,19-nonadecanediol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Pathways Using 19-Aminononadecanoate as a Central Precursor to 19-Aminononadecanol In some embodiments, 19-aminononadecanol is synthesized from the central precursor, 19-aminononadecanoate, by conversion of 19-aminononadecanoate to 19-aminononadecanal by a polypeptide having the activity of a carboxylate reductase classified, for example, under EC 1.2.99.6 or a polypeptide having at least 50%, at least 60%, at least 70%, or at least 85% sequence homology to the amino acid sequence of any one of SEQ ID NOs: 25-39 or SEQ ID NOs: 196-215 in combination with a polypeptide having the activity of a phosphopantetheine transferase classified, for example, under EC 2.7.8.-, such as 2.7.8.7 (e.g., a polypeptide having at least 50%, at least 60%, at least 70%, or at least 85% sequence homology to the amino acid sequence of any one of SEQ ID NOs: 54-57); followed by conversion of 19-aminononadecanal to 19-aminononadecanol by a polypeptide having the activity of an alcohol dehydrogenase classified, for example, under EC 1.1.1.- (e.g., EC 1.1.1.1, EC 1.1.1.2, EC 1.1.1.21, EC 1.1.1.61, or EC 1.1.1.184) (e.g., a polypeptide having at least 50%, at least 60%, at least 70%, or at least 85% sequence homology to the amino acid sequence of any one of SEQ ID NOs: 20-23).

Cultivation Strategy

In some embodiments, the cultivation strategy entails achieving an aerobic, anaerobic, or micro-aerobic cultivation condition.

In some embodiments, the cultivation strategy entails nutrient limitation such as nitrogen, phosphate or oxygen limitation.

In some embodiments, a cell retention strategy using, for example, ceramic hollow fiber membranes can be employed to achieve and maintain a high cell density during either fed-batch or continuous fermentation.

In some embodiments, the principal carbon source fed to the fermentation in the synthesis of one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks) can derive from biological or non-biological feedstocks.

In some embodiments, the biological feedstock can be, can include, or can derive from, monosaccharides, disaccharides, lignocellulose, hemicellulose, cellulose, lignin, levulinic acid and formic acid, triglycerides, glycerol, fatty acids, agricultural waste, condensed distillers' solubles, or municipal waste.

In some embodiments, the feedstock is not glucose.

The efficient catabolism of crude glycerol stemming from the production of biodiesel has been demonstrated in several microorganisms such as *Escherichia coli*, *Cupriavidus necator*, *Pseudomonas oleavorans*, *Pseudomonas putida* and *Yarrowia lipolytica* (Lee et al., *Appl. Biochem. Biotechnol.*, 2012, 166, 1801-1813; Yang et al., *Biotechnology for Biofuels*, 2012, 5:13; Meijnen et al., *Appl. Microbiol. Biotechnol.*, 2011, 90, 885-893).

The efficient catabolism of lignocellulosic-derived levulinic acid has been demonstrated in several organisms such as *Cupriavidus necator* and *Pseudomonas putida* in the synthesis of 3-hydroxyvalerate via the precursor propanoyl-CoA (Jaremko and Yu, *Journal of Biotechnology*, 2011, 155, 2011, 293-298; Martin and Prather, *Journal of Biotechnology*, 2009, 139, 61-67).

The efficient catabolism of lignin-derived aromatic compounds such as benzoate analogues has been demonstrated in several microorganisms such as *Pseudomonas putida*, *Cupriavidus necator* (Bugg et al., *Current Opinion in Biotechnology*, 2011, 22, 394-400; Perez-Pantoj a et al., *FEMS Microbiol. Rev.*, 2008, 32, 736-794).

The efficient utilization of agricultural waste, such as olive mill waste water has been demonstrated in several microorganisms, including *Yarrowia lipolytica* (Papanikolaou et al., *Bioresour. Technol.*, 2008, 99(7), 2419-2428).

The efficient utilization of fermentable sugars such as monosaccharides and disaccharides derived from cellulosic, hemicellulosic, cane and beet molasses, cassava, corn, and other agricultural sources has been demonstrated for several microorganism such as *Escherichia coli*, *Corynebacterium glutamicum* and *Lactobacillus delbrueckii* and *Lactococcus lactis* (see, e.g., Hermann et al, *Journal of Biotechnology*, 2003, 104, 155-172; Wee et al., *Food Technol. Biotechnol.*, 2006, 44(2), 163-172; Ohashi et al., *Journal of Bioscience and Bioengineering*, 1999, 87(5), 647-654).

The efficient utilization of furfural, derived from a variety of agricultural lignocellulosic sources, has been demonstrated for *Cupriavidus necator* (Li et al., *Biodegradation*, 2011, 22, 1215-1225).

In some embodiments, the non-biological feedstock can be, can include, or can derive from natural gas, syngas, $CO_2/H_2$, methanol, ethanol, benzoic acid, non-volatile residue (NVR), a caustic wash waste stream from cyclohexane oxidation processes, or terephthalic acid/isophthalic acid mixture waste streams.

The efficient catabolism of methanol has been demonstrated for the methylotrophic yeast *Pichia pastoris* (Yurimoto et al., *Int J Microbiol.*, 2011, 2011:101298).

The efficient catabolism of ethanol has been demonstrated for *Clostridium kluyveri* (Seedorf et al., *Proc. Natl. Acad. Sci. USA*, 2008, 105(6) 2128-2133).

The efficient catabolism of $CO_2$ and $H_2$, which may be derived from natural gas and other chemical and petrochemical sources, has been demonstrated for *Cupriavidus necator* (Prybylski et al., *Energy, Sustainability and Society*, 2012, 2:11).

The efficient catabolism of syngas has been demonstrated for numerous microorganisms, such as *Clostridium ljungdahlii* and *Clostridium autoethanogenum* (Kopke et al., *Applied and Environmental Microbiology*, 2011, 77(15), 5467-5475).

The efficient catabolism of the non-volatile residue waste stream from cyclohexane processes has been demonstrated for numerous microorganisms, such as Delftia *acidovorans* and *Cupriavidus necator* (Ramsay et al., *Applied and Environmental Microbiology*, 1986, 52(1), 152-156).

In some embodiments, the host microorganism is a prokaryote. For example, the prokaryote can be a bacterium from the genus *Escherichia* such as *Escherichia coli*; from the genus *Clostridia*, such as *Clostridium ljungdahlii*, *Clostridium autoethanogenum*, or *Clostridium kluyveri*; from the genus Corynebacteria, such as *Corynebacterium glutamicum*; from the genus *Cupriavidus*, such as *Cupriavidus necator* or *Cupriavidus metallidurans*; from the genus *Pseudomonas*, such as *Pseudomonas fluorescens*, *Pseudomonas putida*, or *Pseudomonas* oleavorans; from the genus Delftia such as Delftia *acidovorans*; from the genus *Bacillus*, such as *Bacillus* subtillis; from the genus *Lactobacillus*, such as *Lactobacillus delbrueckii*; or from the genus *Lactococcus*, such as *Lactococcus lactis*. Such prokaryotes also can be a source of genes to construct recombinant host cells described herein that are capable of producing one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks).

In some embodiments, the host microorganism is not *Escherichia coli*.

In some embodiments, the host microorganism is a eukaryote. For example, the eukaryote can be a filamentous fungus, e.g., a eukaryote from the genus *Aspergillus*, such as *Aspergillus niger*. Alternatively, the eukaryote can be a yeast, e.g., a eukaryote from the genus *Saccharomyces* such as *Saccharomyces cerevisiae*; from the genus *Pichia* such as *Pichia pastoris*; or from the genus *Yarrowia* such as *Yarrowia lipolytica*; from the genus *Issatchenkia* such as *Issathenkia orientalis*; from the genus *Debaryomyces* such as *Debaryomyces hansenii*; from the genus *Arxula* such as *Arxula adenoinivorans*; or from the genus *Kluyveromyces* such as *Kluyveromyces lactis*. Such eukaryotes also can be a source of genes to construct recombinant host cells described herein that are capable of producing one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks).

Metabolic Engineering Metabolic pathway engineering has successfully been utilized by several groups to produce chemical commodities via fermentation processes. For example, recombinant strains expressing multiple exogenous genes and utilizing multi-step pathways not native to the strains have been developed. Recent advances in metabolic pathway engineering are summarized in, e.g., Chotani, Gopal, et al. "The commercial production of chemicals using pathway engineering." *Biochimica et Biophysica Acta (BBA) —Protein Structure and Molecular Enzymology* 1543.2 (2000): 434-455, Blombach, Bastian, and Bernhard J. Eikmanns. "Current knowledge on isobutanol production with *Escherichia coli, Bacillus subtilis* and *Corynebacterium glutamicum.*" *Bioengineered Bugs* 2.6 (2011): 346-350., and Adkins, Jake, et al. "Engineering microbial chemical factories to produce renewable 'biomonomers'" Synthetic Biology Applications in Industrial Microbiology (2014): 31.

For example, Rathnasingh et al. developed a novel recombinant *Escherichia coli* SH254 strain that can produce 3-hydroxypropionic acid from glycerol via two consecutive enzymatic reactions. To develop the novel strains, Rathnasingh et al. inserted two plasmids, one encoding 5 exogenous genes utilized in the enzymatic reactions, into an *Escherichia coli* SH254 strain. See Rathnasingh, Chelladurai, et al. "Development and evaluation of efficient recombinant *Escherichia coli* strains for the production of 3-hydroxypropionic acid from glycerol." *Biotechnol Bioeng* 104.4 (2009): 729-739.

In addition, Martin et al. engineered the expression of a synthetic amorpha-4,11-diene synthase gene and the mevalonate isoprenoid pathway from *Saccharomyces cerevisiae* in *Escherichia coli*. See Martin, Vincent J J, et al. "Engineering a mevalonate pathway in *Escherichia coli* for production of terpenoids." *Nature Biotechnology* 21.7 (2003): 796-802.

The present document provides methods involving less than all the steps described for all the above pathways. Such methods can involve, for example, one, two, three, four, five, six, seven, eight, nine, ten, eleven, twelve, or more of such steps. Where less than all the steps are included in such a method, the first, and in some embodiments the only, step can be any one of the steps listed.

Furthermore, recombinant hosts described herein can include any combination of the above enzymes such that one or more of the steps, e.g., one, two, three, four, five, six, seven, eight, nine, ten, or more of such steps, can be performed within a recombinant host. This document provides host cells of any of the genera and species listed and genetically engineered to express one or more (e.g., two, three, four, five, six, seven, eight, nine, ten, eleven, twelve, or more) recombinant forms of any of the enzymes recited in the document. Thus, for example, the host cells can contain exogenous nucleic acids encoding enzymes catalyzing one or more of the steps of any of the pathways described herein.

In addition, this document recognizes that where enzymes have been described as accepting CoA-activated substrates, analogous enzyme activities associated with [acp]-bound substrates exist that are not necessarily in the same enzyme class.

Also, this document recognizes that where enzymes have been described accepting (R)-enantiomers of substrate, analogous enzyme activities associated with (S)-enantiomer substrates exist that are not necessarily in the same enzyme class.

This document also recognizes that where an enzyme is shown to accept a particular co-factor, such as NADPH, or a co-substrate, such as acetyl-CoA, many enzymes are promiscuous in terms of accepting a number of different co-factors or co-substrates in catalyzing a particular enzyme activity. Also, this document recognizes that where enzymes have high specificity for e.g., a particular co-factor such as NADH, an enzyme with similar or identical activity that has high specificity for the co-factor NADPH may be in a different enzyme class.

In some embodiments, the enzymes in the pathways outlined herein are the result of enzyme engineering via non-direct or rational enzyme design approaches with aims of improving activity, improving specificity, reducing feedback inhibition, reducing repression, improving enzyme solubility, changing stereo-specificity, or changing co-factor specificity.

In some embodiments, the enzymes in the pathways outlined herein can be gene dosed (i.e., overexpressed by having a plurality of copies of the gene in the host organism), into the resulting genetically modified organism via episomal or chromosomal integration approaches.

In some embodiments, genome-scale system biology techniques such as Flux Balance Analysis can be utilized to devise genome scale attenuation or knockout strategies for directing carbon flux to a difunctional product having an odd number of carbon atoms (i.e., a $C_{2n+3}$ building block, wherein n is an integer greater than or equal to one, such as a $C_5$, $C_7$, $C_9$, $C_{11}$, $C_{13}$, $C_{15}$, $C_{17}$, or $C_{19}$ building block).

Attenuation strategies include, but are not limited to, the use of transposons, homologous recombination (double cross-over approach), mutagenesis, enzyme inhibitors, and RNA interference (RNAi).

In some embodiments, fluxomic, metabolomics, and transcriptomal data can be utilized to inform or support genome-scale system biology techniques, thereby devising genome scale attenuation or knockout strategies in directing carbon flux to a difunctional product having an odd number of carbon atoms (i.e., a $C_{2n+3}$ building block, wherein n is an integer greater than or equal to one, such as a $C_5$, $C_7$, $C_9$, $C_{11}$, $C_{13}$, $C_{15}$, $C_{17}$, or $C_{19}$ building block).

In some embodiments, the host microorganism's tolerance to high concentrations of a difunctional product having an odd number of carbon atoms (i.e., a $C_{2n+3}$ building block, wherein n is an integer greater than or equal to one, such as a $C_5$, $C_7$, $C_9$, $C_{11}$, $C_{13}$, $C_{15}$, $C_{17}$, or $C_{19}$ building block) can be improved through continuous cultivation in a selective environment.

In some embodiments, the host microorganism's endogenous biochemical network can be attenuated or augmented to (1) ensure the intracellular availability of acetyl-CoA and propanedioyl-CoA, (2) create an NADH or NADPH imbalance that may only be balanced via the formation of one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks), (3) prevent degradation of central metabolites, such as central precursors leading to and including one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks) and/or (4) ensure efficient efflux from the cell.

In some embodiments requiring intracellular availability of acetyl-CoA for $C_{2n+3}$ building block synthesis, wherein n is an integer greater than or equal to one, endogenous enzymes catalyzing the hydrolysis acetyl-CoA such as short-chain length thioesterases can be attenuated in the host organism.

In some embodiments requiring condensation of acetyl-CoA and propanoyl-CoA for $C_{2n+3}$ building block synthesis, wherein n is an integer greater than or equal to one, one or more endogenous β-ketothiolases catalyzing the condensation of only acetyl-CoA to acetoacetyl-CoA, such as the endogenous gene products of atoB orphaA, can be attenuated.

In some embodiments requiring the intracellular availability of acetyl-CoA for $C_{2n+3}$ building block synthesis, wherein n is an integer greater than or equal to one, an endogenous phosphotransacetylase generating acetate such as pta can be attenuated (Shen et al., *Appl. Environ. Microbiol.*, 2011, 77(9):2905-2915).

In some embodiments requiring the intracellular availability of acetyl-CoA for $C_{2n+3}$ building block synthesis, wherein n is an integer greater than or equal to one, an endogenous gene in an acetate synthesis pathway encoding an acetate kinase, such as ack, can be attenuated.

In some embodiments requiring the intracellular availability of acetyl-CoA and NADH for $C_{2n+3}$ building block synthesis, wherein n is an integer greater than or equal to one, an endogenous gene encoding an enzyme that catalyzes the degradation of pyruvate to lactate, such as a lactate dehydrogenase encoded by ldhA, can be attenuated (Shen et al., 2011, supra).

In some embodiments requiring the intracellular availability of acetyl-CoA and NADH for $C_{2n+3}$ building block synthesis, wherein n is an integer greater than or equal to one, endogenous genes encoding enzymes, such as a menaquinol-fumarate oxidoreductase, that catalyze the degradation of phophoenolpyruvate to succinate, such as frdBC, can be attenuated (see, e.g., Shen et al., 2011, supra).

In some embodiments requiring the intracellular availability of acetyl-CoA and NADH for $C_{2n+3}$ building block synthesis, wherein n is an integer greater than or equal to one, an endogenous gene encoding an enzyme that catalyzes the degradation of acetyl-CoA to ethanol, such as an alcohol dehydrogenase encoded by adhE, can be attenuated (Shen et al., 2011, supra).

In some embodiments, where pathways require excess NADH co-factor for $C_{2n+3}$ building block synthesis, wherein n is an integer greater than or equal to one, a recombinant formate dehydrogenase gene can be overexpressed in the host organism (Shen et al., 2011, supra). In some embodiments, said formate dehydrogenase is classified under EC 1.1.99.3 or EC 1.2.1.2, such as the gene product of fdhF from, for example, *Escherichia coli* (see UniProtKB Accession No. P07658)

In some embodiments, where pathways require excess NADH or NADPH co-factor for $C_{2n+3}$ building block synthesis, wherein n is an integer greater than or equal to one, an endogenous transhydrogenase dissipating the co-factor imbalance can be attenuated.

In some embodiments, an endogenous gene encoding an enzyme that catalyzes the degradation of pyruvate to ethanol, such as apyruvate decarboxylase, can be attenuated.

In some embodiments, an endogenous gene encoding an enzyme that catalyzes the generation of isobutanol, such as a 2-oxoacid decarboxylase, can be attenuated.

In some embodiments requiring the intracellular availability of acetyl-CoA for $C_{2n+3}$ building block synthesis, wherein n is an integer greater than or equal to one, a recombinant acetyl-CoA synthetase, such as the gene product of acs from, for example, *Escherichia coli* (see UniProtKB Accession No. P27550 (SEQ ID NO: 151)) can be overexpressed in the microorganism (Satoh et al., *J. Bioscience and Bioengineering*, 2003, 95(4):335-341).

In some embodiments, carbon flux can be directed into the pentose phosphate cycle to increase the supply of NADPH by attenuating an endogenous glucose-6-phosphate isomerase, classified, for example, under EC 5.3.1.9.

In some embodiments, carbon flux can be redirected into the pentose phosphate cycle to increase the supply of NADPH by overexpression a 6-phosphogluconate dehydrogenase and/or a transketolase (Lee et al., 2003, *Biotechnology Progress*, 19(5), 1444-1449). In some embodiments, said 6-phosphogluconate dehydrogenase is classified, for example, under EC 1.1.1.44, such as the gene product of PGD from *Homo sapiens* (see UniProtKB Accession No. P52209 (SEQ ID NO: 152)). In some embodiments, said transketolase is classified, for example, under EC 2.2.1.1, such as the gene product of tktA from, for example, *Escherichia coli* (see UniProtKB Accession No. P27302 (SEQ ID NO: 153)).

In some embodiments, where pathways require excess NADPH co-factor in the synthesis of a $C_{2n+3}$ building block, wherein n is an integer greater than or equal to one, a gene such as udhA encoding a puridine nucleotide transhydrogenase can be overexpressed in the host organisms (Brigham et al., *Advanced Biofuels and Bioproducts*, 2012, Chapter 39, 1065-1090).

In some embodiments, where pathways require excess NADPH co-factor in the synthesis of a $C_{2n+3}$ building block, wherein n is an integer greater than or equal to one, a recombinant glyceraldehyde-3-phosphate-dehydrogenase gene such as gapN can be overexpressed in the host organisms (Brigham et al., 2012, supra). In some embodiments, said glyceraldehyde-3-phosphate-dehydrogenase can be classified, for example, under EC 1.2.1.12, such as the gene product of gapA from, for example, *Escherichia coli* (see UniProtKB Accession No. P0A9B2 (SEQ ID NO: 155)).

In some embodiments, where pathways require excess NADPH co-factor in the synthesis of a $C_{2n+3}$ building block, wherein n is an integer greater than or equal to one, a recombinant malic enzyme gene such as maeA or maeB can be overexpressed in the host organisms (Brigham et al., 2012). In some embodiments, said malic enzyme can be classified, for example, under EC 1.1.1.38, such as, for example, the gene product of maeA from, for example, *Escherichia coli* (see UniProtKB Accession No. P26616 (SEQ ID NO: 156)), or EC 1.1.1.40, such as, for example, the gene product of maeB from, for example, *Escherichia coli* (see UniProtKB Accession No. P76558 (SEQ ID NO: 157)).

In some embodiments, where pathways require excess NADPH co-factors in the synthesis of a $C_{2n+3}$ building block, wherein n is an integer greater than or equal to one, a recombinant glucose-6-phosphate dehydrogenase gene such as zwf can be overexpressed in the host organisms (Lim et al., *J. Bioscience and Bioengineering*, 2002, 93(6), 543-549). In some embodiments, said glucose-6-phosphate dehydrogenase may be classified, for example, under EC 1.1.1.49, such as the gene product of zwf from, for example, *Escherichia coli* (see UniProtKB Accession No. P0AC53 (SEQ ID NO: 158)).

In some embodiments, where pathways require excess NADPH co-factor in the synthesis of a $C_{2n+3}$ building block, wherein n is an integer greater than or equal to one, a recombinant fructose 1,6 diphosphatase gene such as jbp can be overexpressed in the host organisms (Becker et al., *J. Biotechnol.*, 2007, 132:99-109). In some embodiments, said fructose 1,6 diphosphatase may be classified, for example, under EC 3.1.3.11, such as, for example, the gene product of fbp from, for example, *Escherichia coli* (see UniProtKB Accession No. P0A993 (SEQ ID NO: 159).

In some embodiments, where pathways require excess NADPH co-factor in the synthesis of a $C_{2n+3}$ building block, wherein n is an integer greater than or equal to one, an endogenous triose phosphate isomerase classified, for example, under EC 5.3.1.1 can be attenuated.

In some embodiments, where pathways require excess NADPH co-factor in the synthesis of a $C_{2n+3}$ building block, wherein n is an integer greater than or equal to one, a recombinant glucose dehydrogenase such as the gene product of gdh can be overexpressed in the host organism (Satoh et al., *J. Bioscience and Bioengineering*, 2003, 95(4):335-341).

In some embodiments, endogenous enzymes facilitating the conversion of NADPH to NADH can be attenuated, such as the NADH generation cycle that may be generated via inter-conversion of glutamate dehydrogenases classified, for example, under EC 1.4.1.2 (NADH-specific) and EC 1.4.1.4 (NADPH-specific). For example, avoiding dissipation of an NADH imbalance towards $C_{2n+3}$ building blocks, wherein n is an integer greater than or equal to one, a NADPH-specific glutamate dehydrogenase can be attenuated.

In some embodiments, an endogenous glutamate dehydrogenase classified, for example, under EC 1.4.1.3 that utilizes both NADH and NADPH as co-factors can be attenuated.

In some embodiments, a membrane-bound enoyl-CoA reductase can be solubilized via expression as a fusion protein to a small soluble protein such as a maltose binding protein (Gloerich et al., FEBS Letters, 2006, 580, 2092-2096).

In some embodiments using hosts that naturally accumulate polyhydroxyalkanoates, an endogenous polymer synthase enzymes can be attenuated in the host strain.

In some embodiments, an L-alanine dehydrogenase, such as a *Mycobacterium tuberculosis* L-alanine dehydrogenase (see UniProtKB Accession No. P9WQB1 (SEQ ID NO: 160)), can be overexpressed in the host to regenerate L-alanine from pyruvate as an amino donor for aminotransferase reactions.

In some embodiments, an L-glutamate dehydrogenase specific for the co-factor used to achieve co-factor imbalance can be overexpressed in the host to regenerate L-glutamate from 2-oxoglutarate as an amino donor for aminotransferase reactions. In some embodiments, said L-glutamate dehydrogenase is classified under, for example, EC 1.4.1.3, such as the gene product of GLUD1 from, for example, *Homo sapiens* (see UniProtKB Accession No. P00367 (SEQ ID NO: 161)). For example, to promote dissipation of the NADH imbalance towards $C_{2n+3}$ building blocks, wherein n is an integer greater than or equal to one, a NADH-specific glutamate dehydrogenase can be overexpressed.

In some embodiments, enzymes such as a pimeloyl-CoA dehydrogenase classified, for example, under EC 1.3.1.62; an acyl-CoA dehydrogenase classified, for example, under EC 1.3.8.7 or EC 1.3.8.1; and/or a glutaryl-CoA dehydrogenase classified, for example, under EC 1.3.8.6 that degrade central metabolites and central precursors leading to and including $C_{2n+3}$ building blocks, wherein n is an integer greater than or equal to one, can be attenuated.

In some embodiments, endogenous enzymes activating $C_{2n+3}$ building blocks, wherein n is an integer greater than or equal to one, via Coenzyme A esterification such as CoA-ligases (e.g., apimeloyl-CoA synthetase) classified, for example, under EC 6.2.1.14 can be attenuated.

In some embodiments, a methanol dehydrogenase and a formaldehyde dehydrogenase can be overexpressed in the host to allow methanol catabolism via formate. In some embodiments, said methanol dehydrogenase may be classified, for example, under EC 1.1.1.244, such as the gene product of mdh from, for example, *Bacillus methanolicus* (see UniProtKB Accession No. P31005 (SEQ ID NO: 162)). In some embodiments, said formaldehyde dehydrogenase may be classified, for example, under EC 1.2.1.46, such as the gene product of fdhA from, for example, *Burkholderia pseudomallei* (see UniProtKB Accession No. A3P364 (SEQ ID NO: 163)).

In some embodiments, an S-adenosylmethionine synthetase can be overexpressed in the host to generate S-Adenosyl-L-methionine as a co-factor for S-adenosyl-L-methionine (SAM)-dependent methyltransferase. In some embodiments, said S-adenosylmethionine synthetase can be classified, for example, under EC 2.5.1.6, such as the gene product of metK from, for example, *Escherichia coli* (see UniProtKB Accession No. P0A817 (SEQ ID NO: 164)).

In some embodiments, the efflux of a $C_{2n+3}$ building block, wherein n is an integer greater than or equal to one, across the cell membrane to the extracellular media can be enhanced or amplified by genetically engineering structural modifications to the cell membrane or increasing any associated transporter activity for a $C_{2n+3}$ building block, wherein n is an integer greater than or equal to one.

The efflux of a diamine having an odd number of carbon atoms can be enhanced or amplified by overexpressing broad substrate range multidrug transporters, such as Blt from *Bacillus subtilis* (Woolridge et al., 1997, *J. Biol. Chem.*, 272(14):8864-8866); AcrB and AcrD from *Escherichia coli* (Elkins & Nikaido, 2002, *J. Bacteriol.*, 184(23), 6490-6499), NorA from *Staphylococcus aereus* (Ng et al., 1994, *Antimicrob Agents Chemother*, 38(6), 1345-1355), or Bmr from *Bacillus subtilis* (Neyfakh, 1992, *Antimicrob Agents Chemother*, 36(2), 484-485). In some embodiments, the diamine having an odd number of carbon atoms may be pentane-1,5-diamine, heptane-1,7-diamine, nonane-1,9-diamine, undecane-1,11-diamine, tridecane-1,13-diamine, pentadecane-1,15-diamine, heptadecane-1,17-diamine, or nonadecane-1,19-diamine.

The efflux of an aminocarboxylate having an odd number of carbon atoms or a diamine having an odd number of carbon atoms can be enhanced or amplified by overexpressing the solute transporters such as the LysE transporter from *Corynebacterium glutamicum* (Bellmann et al., 2001, *Microbiology*, 147, 1765-1774). In some embodiments, the aminocarboxylate having an odd number of carbon atoms may be 5-aminopentanoate, 7-aminoheptanoate, 9-aminononanoate, 11-aminoundecanoate, 13-aminotridecanoate, 15-aminopentadecanoate, 17-aminoheptadecanoate, or 19-aminononadecanoate. In some embodiments, the diamine having an odd number of carbon atoms may be pentane-1,5-diamine, heptane-1,7-diamine, nonane-1,9-diamine, undecane- 1,11-diamine, tridecane-1,13-diamine, pentadecane- 1,15-diamine, heptadecane-1,17-diamine, or nonadecane-1,19-diamine.

The efflux of a dicarboxylic acid having an odd number of carbon atoms can be enhanced or amplified by overexpressing a dicarboxylate transporter, such as the SucE transporter from *Corynebacterium glutamicum* (Huhn et al., *Appl. Microbiol. & Biotech.*, 89(2), 327-335). In some embodiments, the dicarboxylic acid having an odd number of carbon atoms is pentanedioic acid, heptanedioic acid, nonanedioic acid, undecanedioic acid, tridecanedioic acid, pentadecanedioic acid, heptadecanedioic acid, or nonadecanedioic acid.

Metabolically engineering recombinant hosts with various enzymes to produce final products has been successfully demonstrated by several groups. See, e.g., Blombach B et al., *Bioeng Bugs.*, 2011, 2(6):346-50 (teaching successful metabolic engineering of the last two steps of the Ehrlich pathway (by expression of genes encoding a broad range 2-ketoacid decarboxylase and an alcohol dehydrogenase) in recombinant hosts for the production of higher isobutanol); Adkins, J. et al., *Front Microbiol.*, 2012, 3:313 (summarizing numerous biomonomers (such as polyester building-blocks) that can be produced as a result of metabolic and pathway engineering in various recombinant hosts); Chan, S. et al., *Bioresour Technol.*, 2012, 103(1):329-36 (teaching production of succinic acid from sucrose and sugarcane molasses by metabolically engineering *E. coli* with sucrose-utilizing genes (cscKB and cscA)); Lee, S. et al., *Appl Biochem Biotechnol.*, 2012, 167(1):24-38 (teaching successful metabolic engineering of *P. aeruginosa* and *E. coli* for improving long-chain fatty acid production by co-expressing essential enzymes that are involved in the fatty acid synthesis metabolic pathway (accA and fabD) as well as fatty acyl-acyl carrier protein thioesterase gene); Rathnasingh, C. et al., *Biotechnol Bioeng.*, 2009, 104(4):729-39 (teaching successful metabolic engineering of *E. coli* for producing 3-hydroxypropionic acid from glycerol by overexpression of glycerol dehydratase (DhaB) and aldehyde dehydrogenase (AldH) along with glycerol dehydratase reactivase (GDR)).

Producing $C_{2n+3}$ Building Blocks Using a Recombinant Host

Typically, one or more difunctional products having an odd number of carbon atoms (i.e., $C_{2n+3}$ building blocks, wherein n is an integer greater than or equal to one, such as $C_5$, $C_7$, $C_9$, $C_{11}$, $C_{13}$, $C_{15}$, $C_{17}$, or $C_{19}$ building blocks) can be produced by providing a host microorganism and culturing the provided microorganism with a culture medium containing a suitable carbon source as described above. In general, the culture media and/or culture conditions can be such that the microorganisms grow to an adequate density and produce a difunctional product having an odd number of carbon atoms (i.e., a $C_{2n+3}$ building block, wherein n is an integer greater than or equal to one, such as a $C_5$, $C_7$, $C_9$, $C_{11}$, $C_{13}$, $C_{15}$, $C_{17}$, or $C_{19}$ building block) efficiently. For large-scale production processes, any method can be used, such, for example those described in Manual of Industrial Microbiology and Biotechnology, $2^{nd}$ Edition, Editors: A. L. Demain and J. E. Davies, ASM Press; and Principles of Fermentation Technology, P. F. Stanbury and A. Whitaker, Pergamon.

Briefly, a large tank (e.g., a 100 gallon, 200 gallon, 500 gallon, or more tank) containing an appropriate culture medium is inoculated with a particular microorganism. After inoculation, the microorganism is incubated to allow biomass to be produced. Once a desired biomass is reached, the broth containing the microorganisms can be transferred to a second tank. This second tank can be any size. For example, the second tank can be larger, smaller, or the same size as the first tank. Typically, the second tank is larger than the first such that additional culture medium can be added to the broth from the first tank. In addition, the culture medium within this second tank can be the same as, or different from, that used in the first tank.

Once transferred, the microorganisms can be incubated to allow for the production of a difunctional product having an odd number of carbon atoms (i.e., a $C_{2n+3}$ building block, wherein n is an integer greater than or equal to one, such as a $C_5$, $C_7$, $C_9$, $C_{11}$, $C_{13}$, $C_{15}$, $C_{17}$, or $C_{19}$ building block). Once produced, any method can be used to isolate $C_{2n+3}$ building blocks. For example, $C_{2n+3}$ building blocks can be recovered selectively from the fermentation broth via adsorption processes. In the case of a dicarboxylic acid having an odd number of carbon atoms or an aminocarboxylate having an odd number of carbon atoms, the resulting eluate can be further concentrated via evaporation, crystallized via evaporative and/or cooling crystallization, and the crystals recovered via centrifugation. In the case of a diamine having an odd number of carbon atoms or a diol having an odd number of carbon atoms, distillation may be employed to achieve the desired product purity.

In some embodiments, a dicarboxylic acid having an odd number of carbon atoms may be pentanedioic acid, heptanedioic acid, nonanedioic acid, undecanedioic acid, tridecanedioic acid, pentadecanedioic acid, heptadecanedioic acid, or nonadecanedioic acid.

In some embodiments, an aminocarboxylate having an odd number of carbon atoms may be 5-aminopentanoate, 7-aminoheptanoate, 9-aminononanoate, 11-aminoundecanoate, 13-aminotridecanoate, 15-aminopentadecanoate, 17-aminoheptadecanoate, or 19-aminononadecanoate.

In some embodiments, a diamine having an odd number of carbon atoms may be pentane-1,5-diamine, heptane-1,7-diamine, nonane-1,9-diamine, undecane-1,11-diamine, tridecane-1,13-diamine, pentadecane-1,15-diamine, heptadecane-1,17-diamine, or nonadecane-1,19-diamine.

In some embodiments, a diol having an odd number of carbon atoms may be 1,5-pentanediol, 1,7-heptanediol, 1,9-nonanediol, 1,11-undecanediol, 1,13-tridecanediol, 1,15-pentadecanediol, 1,17-heptadecanediol, or 1,19-nonadecanediol.

Any of the recombinant hosts described herein may comprise a deletion in bioH. In some embodiments, the recombinant host does not express BioH. In some embodiments, the recombinant host may comprise a deletion in metJ. In some embodiments, the recombinant host does not express MetJ.

The invention is further described in the following examples, which do not limit the scope of the invention described in the claims.

EXAMPLES

Example 1

Enzyme Activity of Thioesterases Using Heptanedioyl-[acp] or Heptanedioyl-[acp] Methyl Ester as a Substrate and Producing Holo-ACP The release of holo-ACP from pimelyl-[acp] or pimelyl-[acp] methyl ester is catalyzed by the following thioesterases:

| SEQ ID NO | Designation | Organism | Accession No. |
|---|---|---|---|
| SEQ ID NO: 69 | 2TE | Lactobacills plantarum | F9ULU3 |
| SEQ ID NO: 62 | 3TE | Cuphea hookeriana | Q39514 |
| SEQ ID NO: 70 | 4TE | Desulfovibrio piezophilus | M1WJV0 |
| SEQ ID NO: 103 | 5TE | Lactobacillus brevis | Q03SR8 |
| SEQ ID NO: 104 | 6TE | Lactobacillus delbrueckii | Q048X3 |
| SEQ ID NO: 71 | 7TE | Streptococcus dysgalactiae | C5WH65 |
| SEQ ID NO: 105 | 8TE | Clostridium perfringens | Q0TM32 |
| SEQ ID NO: 106 | 9TE | Treponema azatonutricium | F5YA29 |
| SEQ ID NO: 107 | 10TE | Clostridium hathewayi | N9VXF4 |
| SEQ ID NO: 108 | 11TE | Bacillus coagulans | F7Z1I0 |
| SEQ ID NO: 109 | 12TE | Bdellovibrio bacteriovorus | CAE80300 |
| SEQ ID NO: 110 | 13TE | Treponema denticola | M2CWP1 |
| SEQ ID NO: 111 | 14TE | Paenibacillus lactis | G4HNN3 |
| SEQ ID NO: 112 | 15TE | Cuphea palustris | AAC49179.1 |
| SEQ ID NO: 63 | 16TE | Umbellutaria californica | AAC49001.1 |
| SEQ ID NO: 64 | 17TE | Bacillus subtilis | P49851 |
| SEQ ID NO: 65 | 18TE | Bacillus subtilis | Q45061 |
| SEQ ID NO: 66 | 19TE | Bacillus subtilis | P14205 |

Figure 41:
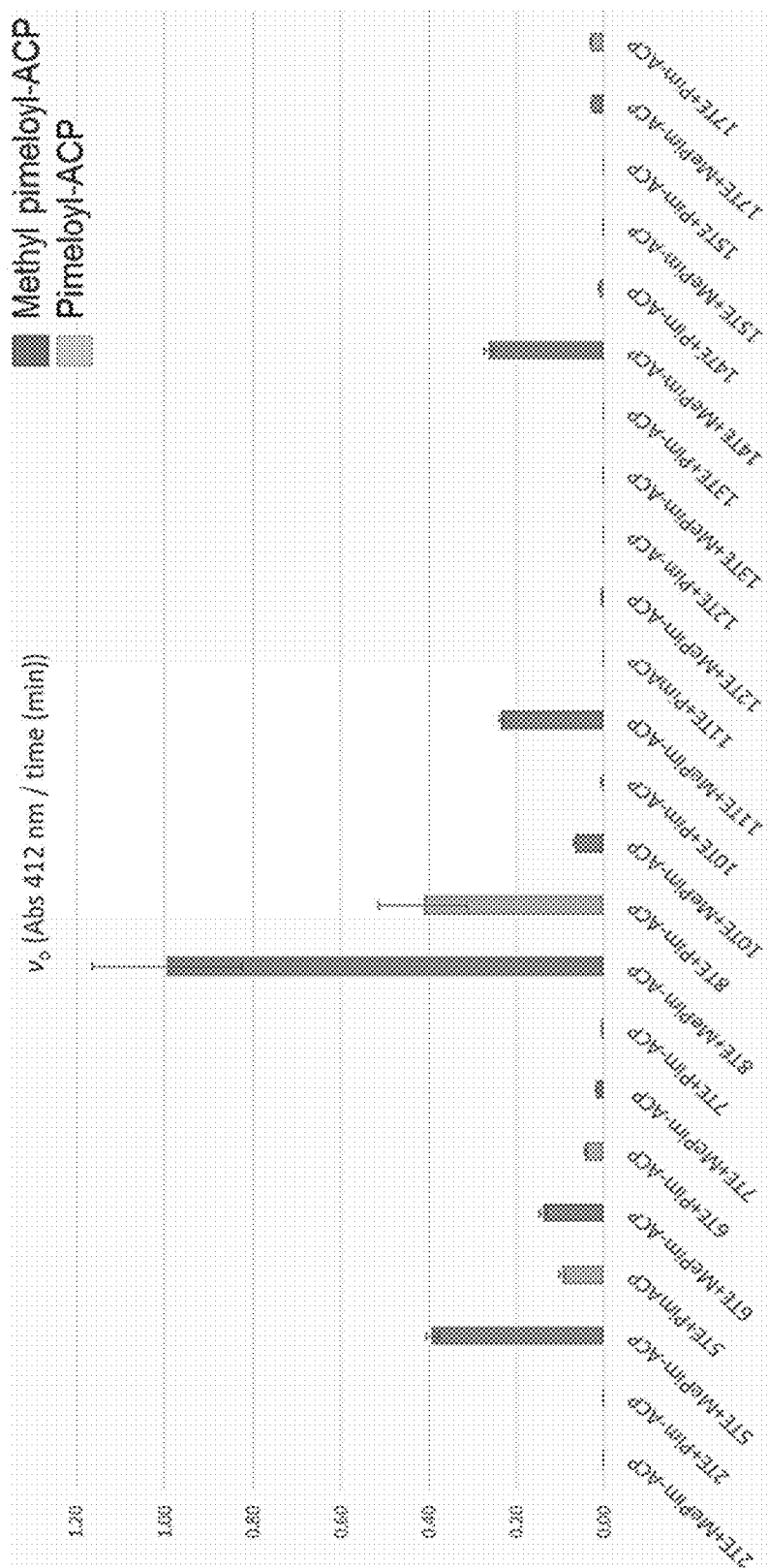
FIG. 41 is a bar graph summarizing the change in absorbance at 412 nm, which is a measure of the release of holo-ACP and the activity of thioesterases for converting heptanedioyl-[acp] or heptanedioyl-[acp] methyl ester.

The thioesterases were expressed and purified following procedures disclosed herein. The enzyme activity assay was performed in duplicate or triplicate in a buffer having heptanedioyl-[acp] or heptanedioyl-[acp] methyl ester as substrate. The enzyme activity assay reaction was initiated by adding purified thioesterase gene products to the assay buffer and incubating at 37° C. for 30 min. The release of holo-ACP was monitored by absorbance at 412 nm. The absorbance associated with the empty vector control is very low. Many of the gene products of thioesterases accepted heptanedioyl-[acp] or heptanedioyl-[acp] methyl ester as substrate as confirmed via relative spectrophotometry (see FIG. 41). Notably, some thioesterases (e.g., 5TE, 6TE, 8TE, 11TE, and 14 TE) synthesized holo-ACP more efficiently using heptanedioyl-[acp] methyl ester as substrate, when compared to using heptanedioyl-[acp] as substrate. See FIG. 41.

Example 2

Enzyme Activity of Aminotransferase Using 7-Oxoheptanoate as a Substrate and Forming 7-Aminoheptanoate A sequence encoding an N-terminal His-tag was added to the genes from *Chromobacterium violaceum*, *Pseudomonas syringae*, *Rhodobacter sphaeroides*, and *Vibrio Fluvialis* encoding the aminotransferases of SEQ ID NOs: 116 (GenBank Accession No. AAQ59697.1), 126 (GenBank Accession No. AAY39893.1), 127 (GenBank Accession No. ABA81135.1), and 128 (GenBank Accession No. AEA39183.1), respectively such that N-terminal HIS tagged aminotransferases could be produced. Each of the resulting modified genes was cloned into a pET21a expression vector under control of the T7 promoter and each expression vector was transformed into a BL21 [DE3] *E. coli* host. The resulting recombinant *E. coli* strains were cultivated at 37° C. in a 250 mL shake flask culture containing 50 mL LB media and antibiotic selection pressure, with shaking at 230 rpm. Each culture was induced overnight at 16° C. using 1 mM IPTG.

The pellet from each induced shake flask culture was harvested via centrifugation. Each pellet was resuspended and lysed via sonication. The cell debris was separated from the supernatant via centrifugation and the cell free extract was used immediately in enzyme activity assays.

Enzyme activity assays in the reverse direction (i.e., 7-aminoheptanoate to 7-oxoheptanoate) were performed in a buffer composed of a final concentration of 50 mM HEPES buffer (pH=7.5), 10 mM 7-aminoheptanoate, 10 mM pyruvate and 100 µM pyridoxyl 5' phosphate. Each enzyme activity assay reaction was initiated by adding cell free extract of the aminotransferase gene product or the empty vector control to the assay buffer containing the 7-aminoheptanoate and incubated at 25° C. for 4 h, with shaking at 250 rpm. The formation of L-alanine from pyruvate was quantified via RP-HPLC.

Figure 47:
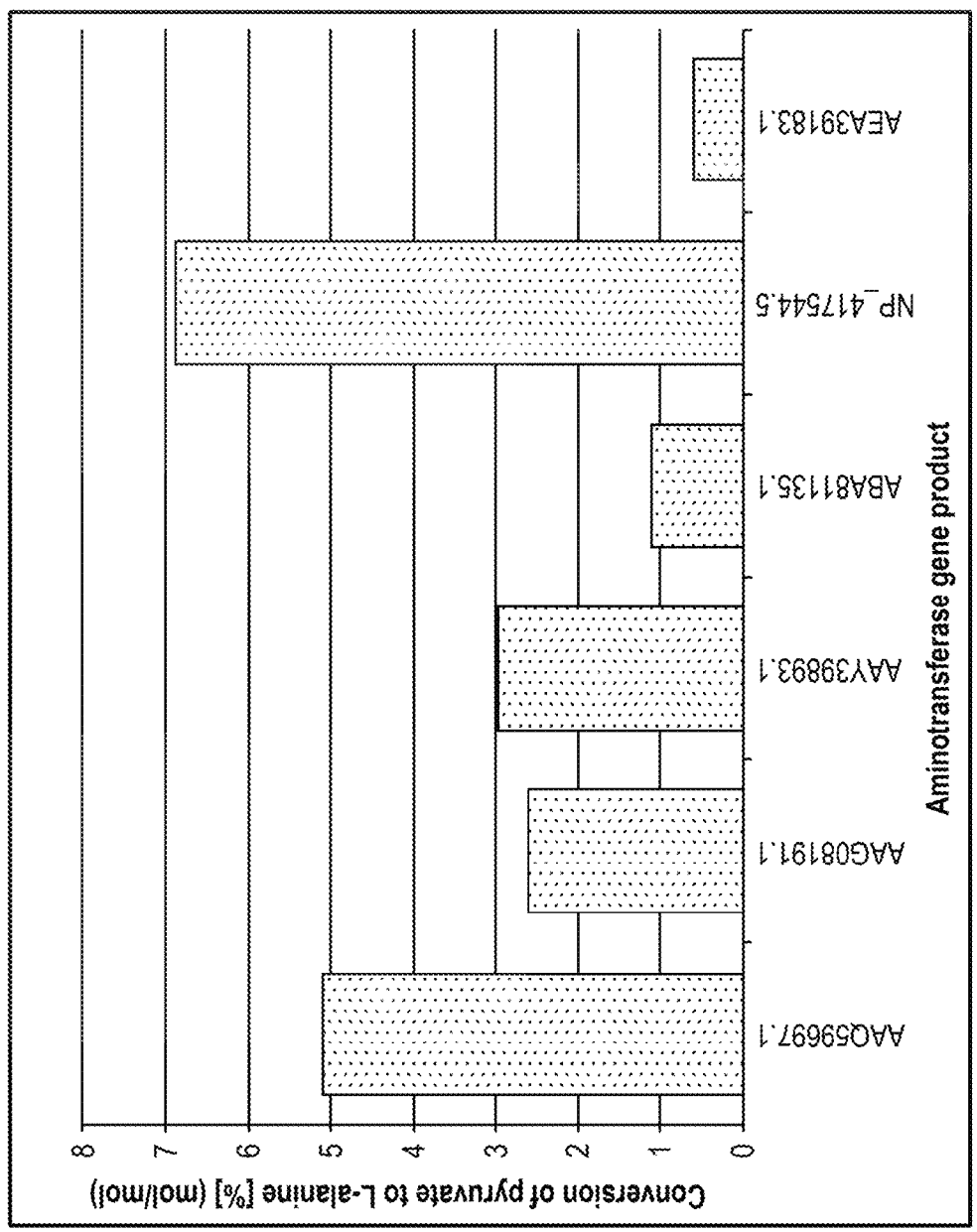
FIG. 47 is a bar graph summarizing the percent conversion after 4 hours of pyruvate to L-alanine (mol/mol) as a measure of the aminotransferase activity of the enzyme only controls (no substrate).
Figure 48:
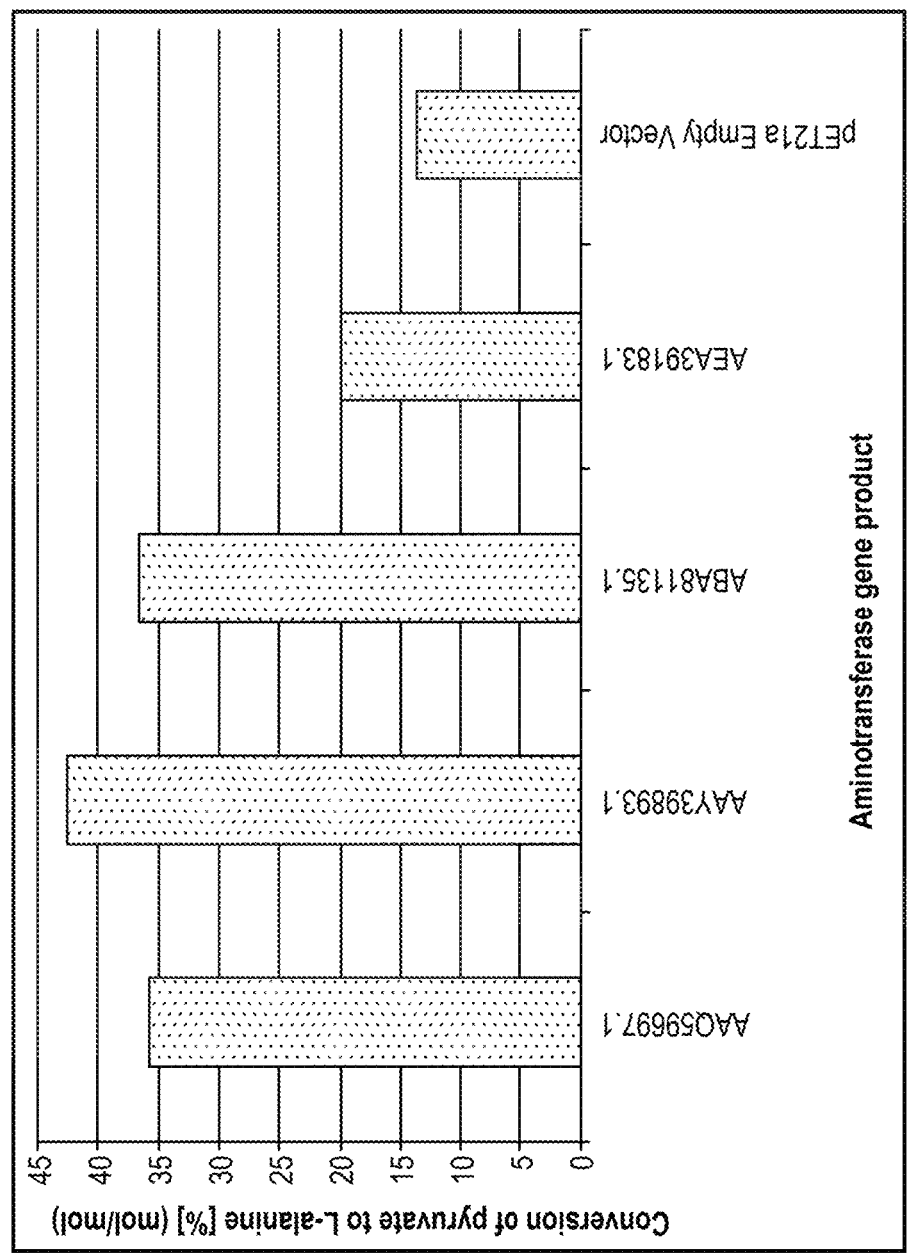
FIG. 48 is a bar graph of the percent conversion after 4 hours of pyruvate to L-alanine (mol/mol) as a measure of the aminotransferase activity for converting 7-aminoheptanoate to 7-oxoheptanoate relative to the empty vector control.

Each enzyme only control without 7-aminoheptanoate demonstrated low base line conversion of pyruvate to L-alanine. See FIG. 47. The gene product of SEQ ID NOs: 116 (GenBank Accession No. AAQ59697.1), 126 (GenBank Accession No. AAY39893.1), 127 (GenBank Accession No. ABA81135.1), and 128 (GenBank Accession No. AEA39183.1) accepted 7-aminoheptanote as substrate as confirmed against the empty vector control. See FIG. 48.

Figure 49:
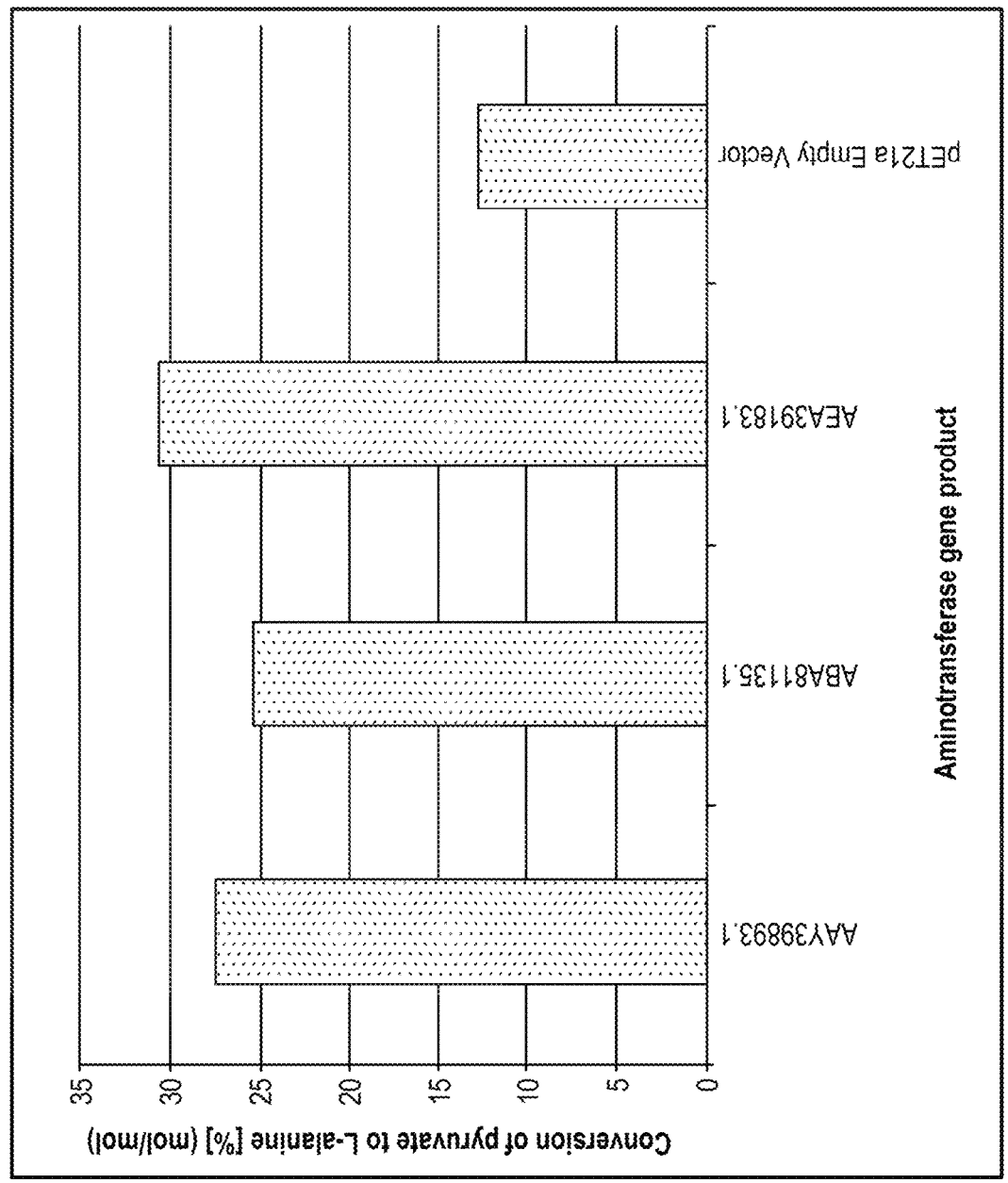
FIG. 49 is a bar graph of the percent conversion after 4 hours of L-alanine to pyruvate (mol/mol) as a measure of the aminotransferase activity for converting 7-oxoheptanoate to 7-aminoheptanoate relative to the empty vector control.

Enzyme activity in the forward direction (i.e., 7-oxoheptanoate to 7-aminoheptanoate) was confirmed for the aminotransferases of SEQ ID NO: 126 (GenBank Accession No. AAY39893.1), SEQ ID NO: 127 (GenBank Accession No. ABA81135.1), and SEQ ID NO: 128 (GenBank Accession No. AEA39183.1). Enzyme activity assays were performed in a buffer composed of a final concentration of 50 mM HEPES buffer (pH=7.5), 10 mM 7-oxoheptanoate, 10 mM L-alanine and 100 µM pyridoxyl 5' phosphate. Each enzyme activity assay reaction was initiated by adding a cell free extract of the aminotransferase gene product or the empty vector control to the assay buffer containing the 7-oxoheptanoate and incubated at 25° C. for 4 h, with shaking at 250 rpm. The formation of pyruvate was quantified via RP-HPLC. The gene product of SEQ ID NO: 126 (GenBank Accession No. AAY39893.1), SEQ ID NO: 127 (GenBank Accession No. ABA81135.1), and SEQ ID NO: 128 (GenBank Accession No. AEA39183.1) accepted 7-oxoheptanoate as a substrate as confirmed against the empty vector control. See FIG. 49. The reversibility of the aminotransferase activity was confirmed, demonstrating that the aminotransferases of SEQ ID NO: 126 (GenBank Accession No. AAY39893.1), SEQ ID NO: 127 (GenBank Accession No. ABA81135.1), and SEQ ID NO: 128 (GenBank Accession No. AEA39183.1) accepted 7-oxoheptanoate as substrate and synthesized 7-aminoheptanoate as a reaction product.

Example 3

Enzyme Activity of Carboxylate Reductase Using Heptanedioate as a Substrate and Forming 7-Oxoheptanoate A sequence encoding a HIS-tag was added to the genes from *Segniliparus* rugosus and *Segniliparus rotundus* that encode the carboxylate reductases of SEQ ID NOs: 31 (GenBank Accession No. EFV11917.1) and 38 (GenBank Accession No. ADG98140.1), respectively, such that N-terminal HIS tagged carboxylate reductases could be produced. Each of the modified genes was cloned into a pET Duet expression vector along with a sfp gene encoding a HIS-tagged phosphopantetheine transferase from *Bacillus subtilis*, both under the T7 promoter. Each expression vector was transformed into a BL21[DE3] *E. coli* host and the resulting recombinant *E. coli* strains were cultivated at 37° C. in a 250 mL shake flask culture containing 50 mL LB media and antibiotic selection pressure, with shaking at 230 rpm. Each culture was induced overnight at 37° C. using an auto-induction media.

The pellet from each induced shake flask culture was harvested via centrifugation. Each pellet was resuspended and lysed via sonication, and the cell debris was separated from the supernatant via centrifugation. The carboxylate reductases and phosphopantetheine transferases were purified from the supernatant using Ni-affinity chromatography, diluted 10-fold into 50 mM HEPES buffer (pH=7.5), and concentrated via ultrafiltration.

Figure 42:
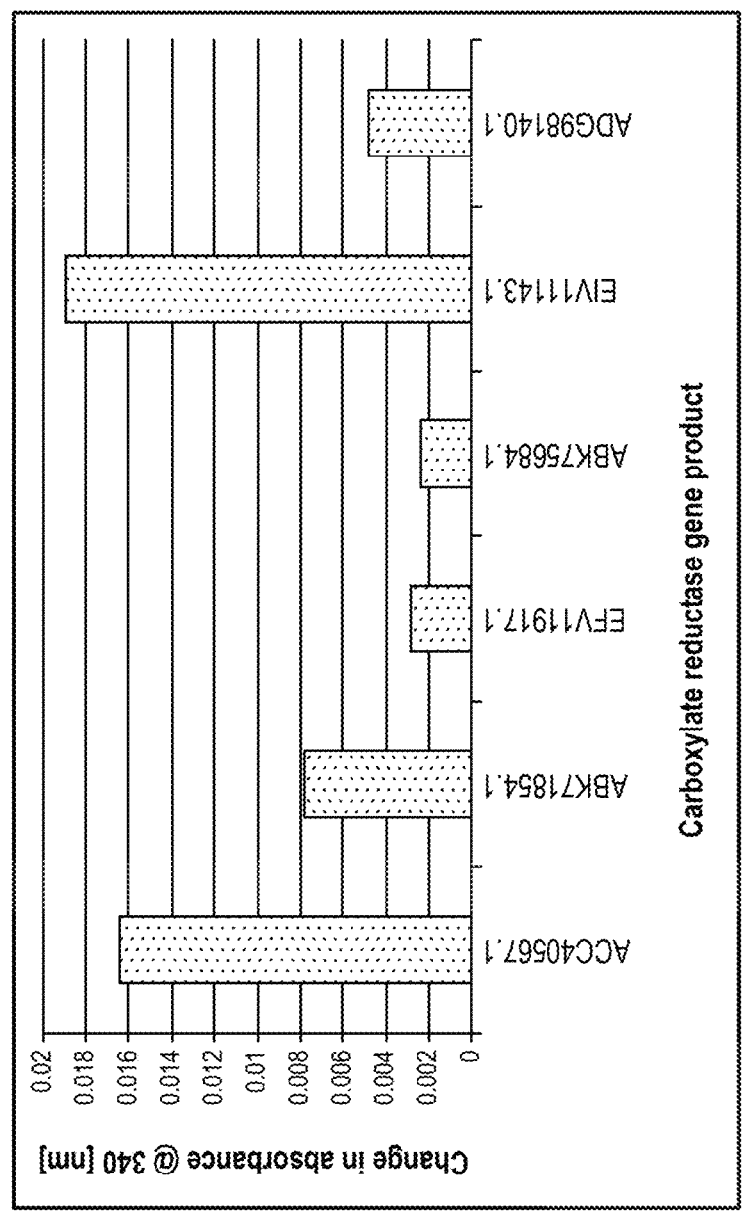
FIG. 42 is a bar graph summarizing the change in absorbance at 340 nm after 20 minutes, which is a measure of the consumption of NADPH and activity of carboxylate reductases relative to the enzyme only controls (no substrate).

Enzyme activity assays (i.e., from heptanedioate to 7-oxoheptanoate) were performed in triplicate in a buffer composed of a final concentration of 50 mM HEPES buffer (pH=7.5), 2 mM heptanedioate, 10 mM MgCl$_2$, 1 mM ATP, and 1 mM NADPH. Each enzyme activity assay reaction was initiated by adding purified carboxylate reductase and phosphopantetheine transferase gene products or the empty vector control to the assay buffer containing the heptanedioate and then incubated at room temperature for 20 min. The consumption of NADPH was monitored by absorbance at 340 nm. Each enzyme only control without heptanedioate demonstrated low base line consumption of NADPH. See FIG. 42.

Figure 43:
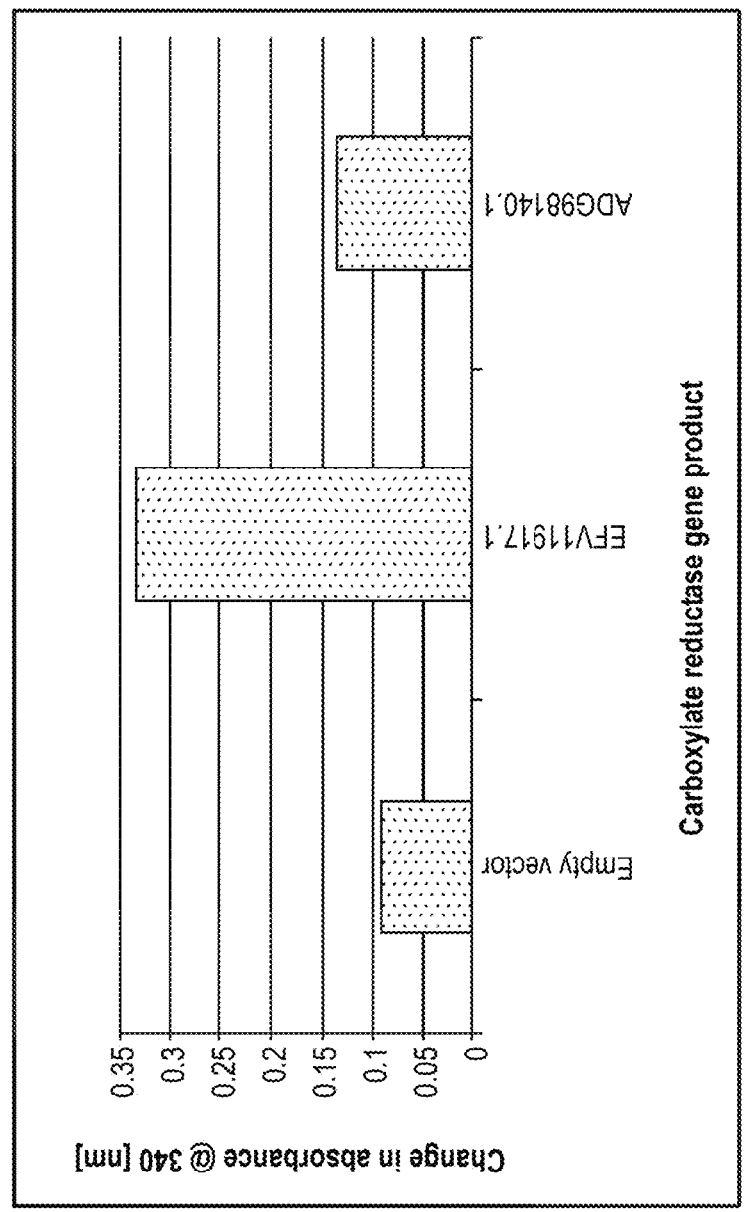
FIG. 43 is a bar graph of the change in absorbance at 340 nm after 20 minutes, which is a measure of the consumption of NADPH and the activity of carboxylate reductases for converting heptanedioate to 7-oxoheptanoate relative to the empty vector control.

The gene products of SEQ ID NO: 31 (GenBank Accession No. EFV11917.1) and SEQ ID NO: 38 (GenBank Accession No. ADG98140.1), enhanced by the gene product of sfp, accepted heptanedioate as substrate, as confirmed against the empty vector control (see FIG. 43), and synthesized 7-oxoheptanoate.

Example 4

Enzyme Activity of Carboxylate Reductase Using 7-Hydroxyheptanoate as a Substrate and Forming 7-Hydroxyheptanal A sequence encoding a His-tag was added to the genes from *Mycobacterium marinum*, *Mycobacterium smegmatis*, *Segniliparus rugosus*, *Mycobacterium smegmatis*, *Mycobacterium massiliense*, and *Segniliparus rotundus* that encode the carboxylate reductases of SEQ ID NOs: 25 (GenBank Accession No. ACC40567.1), 27 (GenBank Accession No. ABK75684.1), 29 (GenBank Accession No. ABK71854.1), 31 (GenBank Accession No. EFV11917.1), 37 (GenBank Accession No. EIV11143.1), and 38 (GenBank Accession No. ADG98140.1) such that N-terminal HIS tagged carboxylate reductases could be produced. Each of the modified genes was cloned into a pET Duet expression vector alongside a sfp gene encoding a His-tagged phosphopantetheine transferase from *Bacillus subtilis*, both under control of the T7 promoter.

Each expression vector was transformed into a BL21 [DE3] *E. coli* host and the resulting recombinant *E. coli* strains were cultivated at 37° C. in a 250 mL shake flask culture containing 50 mL LB media and antibiotic selection pressure, with shaking at 230 rpm. Each culture was induced overnight at 37° C. using an auto-induction media.

The pellet from each induced shake flask culture was harvested via centrifugation. Each pellet was resuspended and lysed via sonication. The cell debris was separated from the supernatant via centrifugation. The carboxylate reductases and phosphopantetheine transferase were purified from the supernatant using Ni-affinity chromatography, diluted 10-fold into 50 mM HEPES buffer (pH=7.5) and concentrated via ultrafiltration.

Enzyme activity (i.e., 7-hydroxyheptanoate to 7-hydroxyheptanal) assays were performed in triplicate in a buffer composed of a final concentration of 50 mM HEPES buffer (pH=7.5), 2 mM 7-hydroxyheptanal, 10 mM MgCl$_2$, 1 mM ATP, and 1 mM NADPH. Each enzyme activity assay reaction was initiated by adding purified carboxylate reductase and phosphopantetheine transferase or the empty vector control to the assay buffer containing the 7-hydroxyheptanoate and then incubated at room temperature for 20 min. The consumption of NADPH was monitored by absorbance at 340 nm. Each enzyme only control without 7-hydroxyheptanoate demonstrated low base line consumption of NADPH. See FIG. 42.

Figure 44:
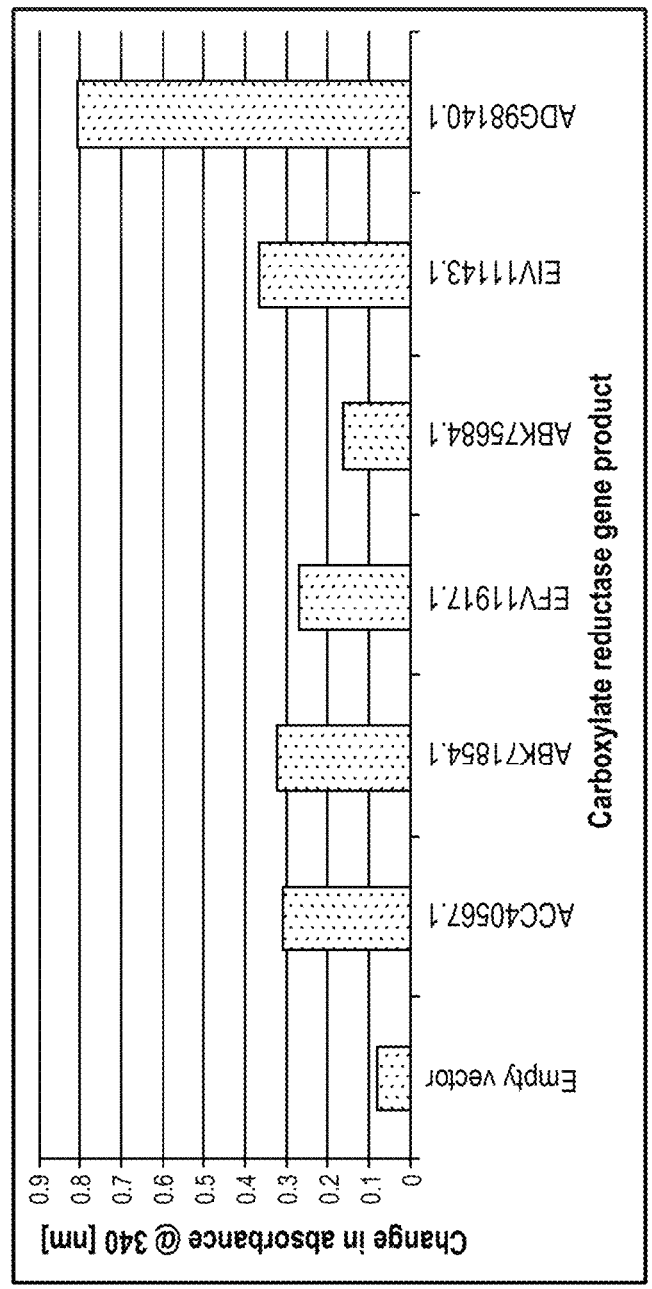
FIG. 44 is a bar graph of the change in absorbance at 340 nm after 20 minutes, which is a measure of the consumption of NADPH and the activity of carboxylate reductases for converting 7-hydroxyheptanoate to 7-hydroxyheptanal relative to the empty vector control.

The gene products of SEQ ID NOs: 25 (GenBank Accession No. ACC40567.1), 27 (GenBank Accession No. ABK75684.1), 29 (GenBank Accession No. ABK71854.1), 31 (GenBank Accession No. EFV11917.1), 37 (GenBank Accession No. EIV11143.1), and 38 (GenBank Accession No. ADG98140.1), enhanced by the gene product of sfp, accepted 7-hydroxyheptanoate as substrate as confirmed against the empty vector control (see FIG. 44), and synthesized 7-hydroxyheptanal.

Example 5

Enzyme Activity of Aminotransferase for 7-Aminoheptanol, Forming 7-Oxoheptanol

A nucleotide sequence encoding an N-terminal His-tag was added to the *Chromobacterium violaceum*, *Pseudomonas syringae* and *Rhodobacter sphaeroides* genes encoding the aminotransferases of SEQ ID NOs: 116 (GenBank Accession No. AAQ59697.1), 126 (GenBank Accession No. AAY39893.1), and 127 (GenBank Accession No. ABA81135.1), respectively such that N-terminal HIS tagged aminotransferases could be produced. The modified genes were cloned into a pET21a expression vector under the T7 promoter. Each expression vector was transformed into a BL21[DE3] *E. coli* host. Each resulting recombinant *E. coli* strain were cultivated at 37° C. in a 250 mL shake flask culture containing 50 mL LB media and antibiotic selection pressure, with shaking at 230 rpm. Each culture was induced overnight at 16° C. using 1 mM IPTG.

The pellet from each induced shake flask culture was harvested via centrifugation. Each pellet was resuspended and lysed via sonication. The cell debris was separated from the supernatant via centrifugation and the cell free extract was used immediately in enzyme activity assays.

Enzyme activity assays in the reverse direction (i.e., 7-aminoheptanol to 7-oxoheptanol) were performed in a buffer composed of a final concentration of 50 mM HEPES buffer (pH=7.5), 10 mM 7-aminoheptanol, 10 mM pyruvate, and 100 µM pyridoxyl 5' phosphate. Each enzyme activity assay reaction was initiated by adding cell free extract of the aminotransferase gene product or the empty vector control to the assay buffer containing the 7-aminoheptanol and then incubated at 25° C. for 4 h, with shaking at 250 rpm. The formation of L-alanine was quantified via RP-HPLC.

Each enzyme only control without 7-aminoheptanol had low base line conversion of pyruvate to L-alanine. See FIG. 47.

Figure 52:
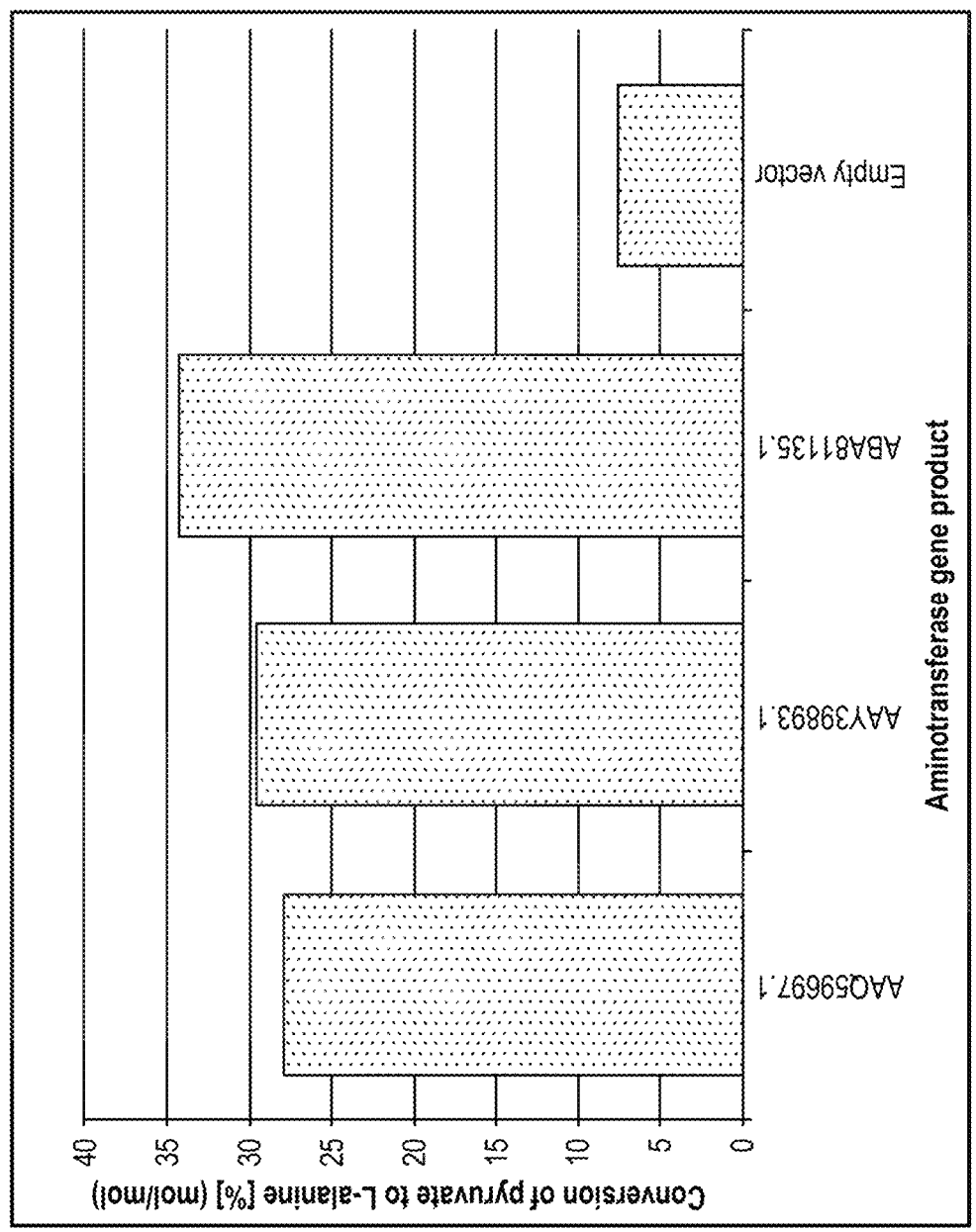
FIG. 52 is a bar graph of the percent conversion after 4 hours of pyruvate to L-alanine (mol/mol) as a measure of the aminotransferase activity for converting 7-aminoheptanol to 7-oxoheptanol relative to the empty vector control.

The gene products of SEQ ID NOs: 116 (GenBank Accession No. AAQ59697.1), 126 (GenBank Accession No. AAY39893.1), and 127 (GenBank Accession No. ABA81135.1) accepted 7-aminoheptanol as a substrate as confirmed against the empty vector control (see FIG. 52) and synthesized 7-oxoheptanol as reaction product. Given the reversibility of the aminotransferase activity (see Example 2), it can be concluded that the gene products of SEQ ID NOs: 116 (GenBank Accession No. AAQ59697.1), 126 (GenBank Accession No. AAY39893.1), and 127 (GenBank Accession No. ABA81135.1) accept 7-oxoheptanol as substrate and form 7-aminoheptanol.

Example 6

Enzyme Activity of Aminotransferase Using Heptane-1,7-Diamine as a Substrate and Forming 7-Aminoheptanal A sequence encoding an N-terminal His-tag was added to the *Chromobacterium violaceum, Pseudomonas aeruginosa, Pseudomonas syringae, Rhodobacter sphaeroides, Escherichia coli,* and *Vibrio fluvialis* genes encoding the aminotransferases of SEQ ID NOs: 116 (GenBank Accession No. AAQ59697.1), 119 (RefSeq Accession No. NP_417544.5), 125 (GenBank Accession No. AAGO8191.1), 126 (GenBank Accession No. AAY39893.1), 127 (GenBank Accession No. ABA81135.1), and 128 (GenBank Accession No. AEA39183.1), respectively such that N-terminal HIS tagged aminotransferases could be produced. The modified genes were cloned into a pET21a expression vector under the T7 promoter. Each expression vector was transformed into a BL21[DE3] *E. coli* host. Each resulting recombinant *E. coli* strain were cultivated at 37° C. in a 250 mL shake flask culture containing 50 mL LB media and antibiotic selection pressure, with shaking at 230 rpm. Each culture was induced overnight at 16° C. using 1 mM IPTG.

The pellet from each induced shake flask culture was harvested via centrifugation. Each pellet was resuspended and lysed via sonication. The cell debris was separated from the supernatant via centrifugation and the cell free extract was used immediately in enzyme activity assays.

Enzyme activity assays in the reverse direction (i.e., heptane-1,7-diamine to 7-aminoheptanal) were performed in a buffer composed of a final concentration of 50 mM HEPES buffer (pH=7.5), 10 mM heptane-1,7-diamine, 10 mM pyruvate, and 100 µM pyridoxyl 5' phosphate. Each enzyme activity assay reaction was initiated by adding cell free extract of the aminotransferase gene product or the empty vector control to the assay buffer containing the heptane-1,7-diamine and then incubated at 25° C. for 4 h, with shaking at 250 rpm. The formation of L-alanine was quantified via RP-HPLC.

Each enzyme only control without heptane-1,7-diamine had low base line conversion of pyruvate to L-alanine. See FIG. 47.

Figure 50:
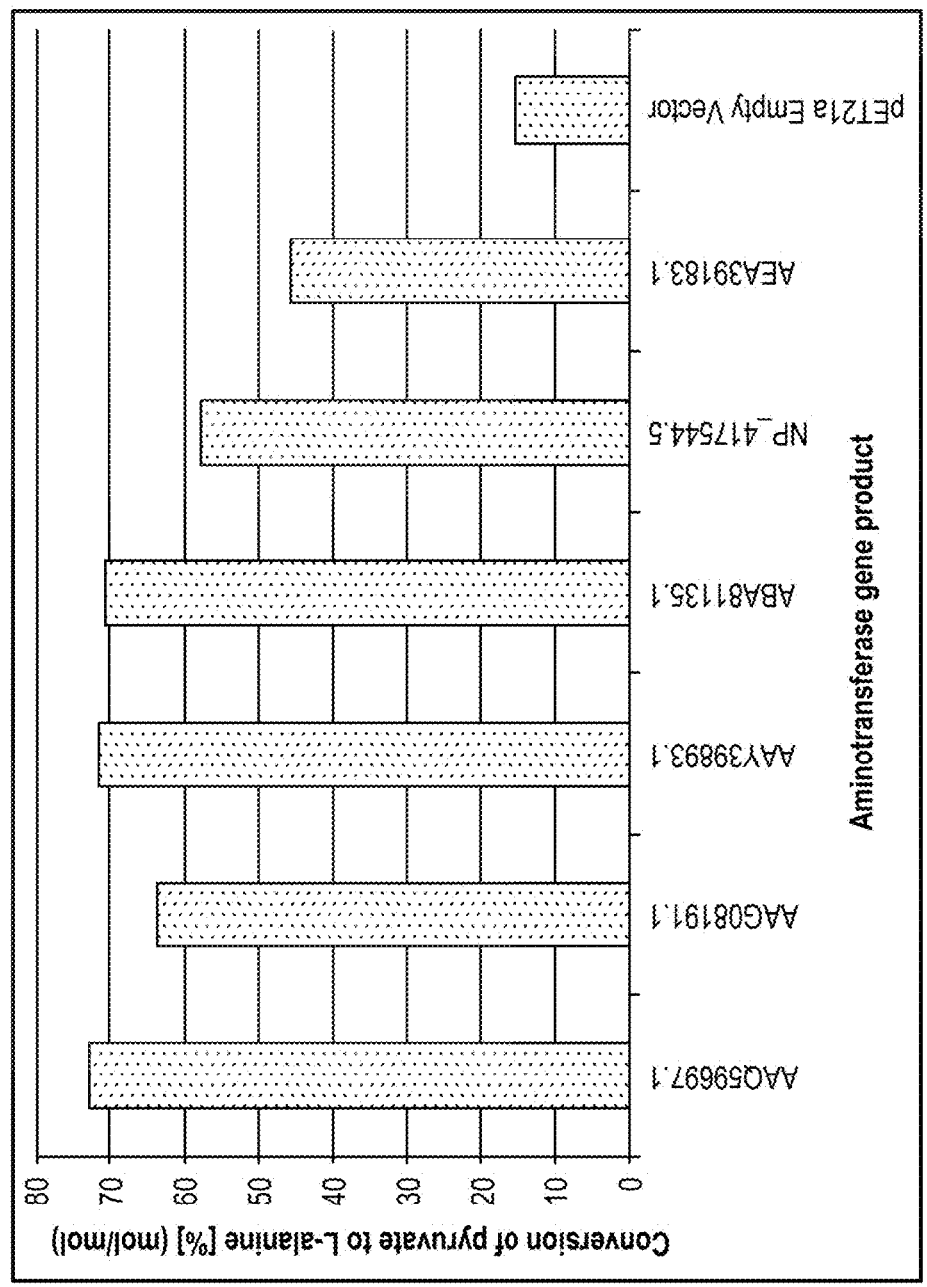
FIG. 50 is a bar graph of the percent conversion after 4 hours of pyruvate to L-alanine (mol/mol) as a measure of the aminotransferase activity for converting heptane-1,7-diamine to 7-aminoheptanal relative to the empty vector control.

The gene products of SEQ ID NOs: 116 (GenBank Accession No. AAQ59697.1), 119 (RefSeq Accession No. NP_417544.5), 125 (GenBank Accession No. AAG08191.1), 126 (GenBank Accession No. AAY39893.1), 127 (GenBank Accession No. ABA81135.1), and 128 (GenBank Accession No. AEA39183.1) accepted heptane-1,7-diamine as substrate as confirmed against the empty vector control (see FIG. 50) and synthesized 7-aminoheptanal as reaction product. Given the reversibility of the aminotransferase activity (see Example 2), it can be concluded that the gene products of SEQ ID NOs: 116, 119, and 125-128 accept 7-aminoheptanal as a substrate and form heptane-1,7-diamine.

Example 7

Enzyme Activity of Carboxylate Reductase for N7-Acetyl-7-Aminoheptanoate, Forming N7-Acetyl-7-Aminoheptanal The activity of each of the N-terminal His-tagged carboxylate reductases of SEQ ID NOs: 29 (GenBank Accession No. ABK71854.1), 37 (Genbank Accession No. EIV11143.1), and 38 (GenBank Accession No. ADG98140.1) (see Examples 4) for converting N7-acetyl-7-aminoheptanoate to N7-acetyl-7-aminoheptanal was assayed in triplicate in a buffer composed of a final concentration of 50 mM HEPES buffer (pH=7.5), 2 mM N7-acetyl-7-aminoheptanoate, 10 mM MgCl$_2$, 1 mM ATP, and 1 mM NADPH. The assays were initiated by adding purified carboxylate reductase and phosphopantetheine transferase or the empty vector control to the assay buffer containing the N7-acetyl-7-aminoheptanoate then incubated at room temperature for 20 min. The consumption of NADPH was monitored by absorbance at 340 nm. Each enzyme only control without N7-acetyl-7-aminoheptanoate demonstrated low base line consumption of NADPH. See FIG. 42.

Figure 45:
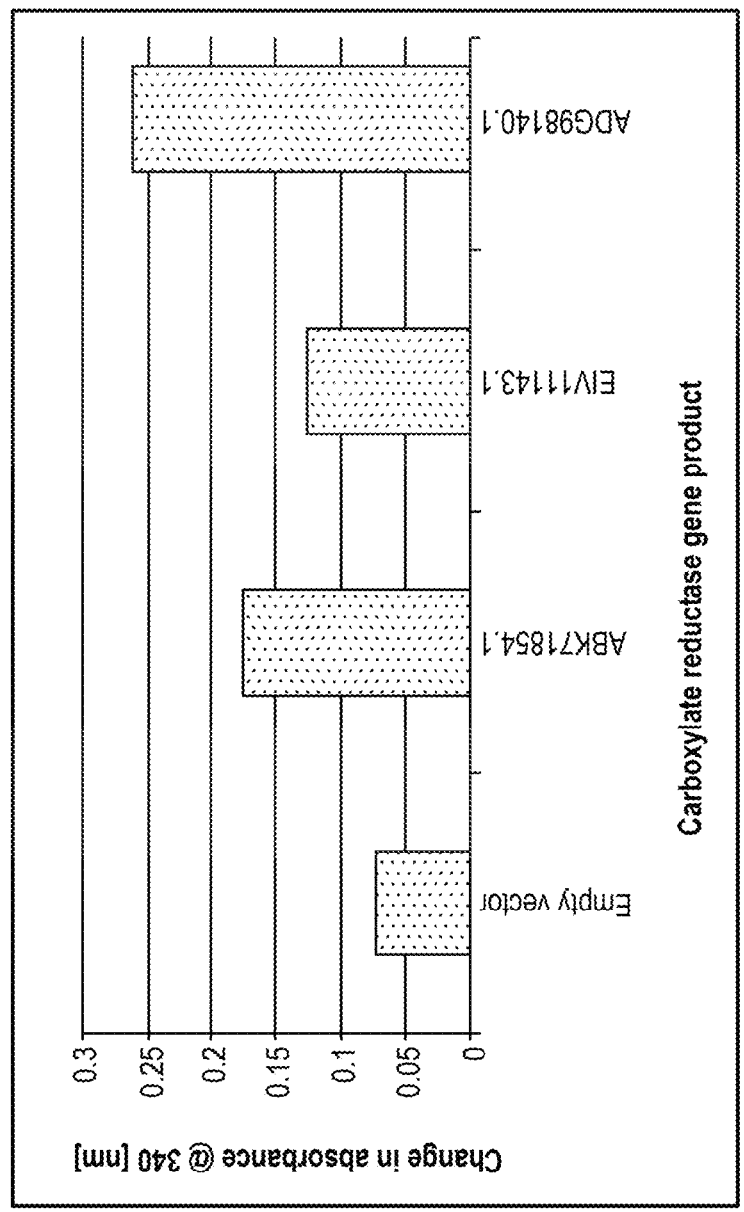
FIG. 45 is a bar graph of the change in absorbance at 340 nm after 20 minutes, which is a measure of the consumption of NADPH and the activity of carboxylate reductases for converting N7-acetyl-7-aminoheptanoate to N7-acetyl-7-aminoheptanal relative to the empty vector control.

The gene products of SEQ ID NOs: 29, 37, and 38, enhanced by the gene product of sfp, accepted N7-acetyl-7-aminoheptanoate as substrate as confirmed against the empty vector control (see FIG. 45), and synthesized N7-acetyl-7-aminoheptanal.

Example 8

Enzyme Activity of Aminotransferase Using N7-Acetyl-1,7-Diaminoheptane, and Forming N7-Acetyl-7-Aminoheptanal The activity of the N-terminal His-tagged aminotransferases of SEQ ID NOs: 116 (GenBank Accession No. AAQ59697.1), 119 (RefSeq Accession No. NP_417544.5), 125 (GenBank Accession No. AAGO8191.1), 126 (GenBank Accession No. AAY39893.1), 127 (GenBank Accession No. ABA81135.1), and 128 (GenBank Accession No. AEA39183.1) (see Example 6) for converting N7-acetyl-1,7-diaminoheptane to N7-acetyl-7-aminoheptanal was assayed using a buffer composed of a final concentration of 50 mM HEPES buffer (pH=7.5), 10 mM N7-acetyl-1,7-diaminoheptane, 10 mM pyruvate and 100 µM pyridoxyl 5' phosphate. Each enzyme activity assay reaction was initiated by adding a cell free extract of the aminotransferases or the empty vector control to the assay buffer containing the N7-acetyl-1,7-diaminoheptane then incubated at 25° C. for 4 h, with shaking at 250 rpm. The formation of L-alanine was quantified via RP-HPLC.

Each enzyme only control without N7-acetyl-1,7-diaminoheptane demonstrated low base line conversion of pyruvate to L-alanine. See FIG. 47.

The gene product of SEQ ID NOs: 116 (GenBank Accession No. AAQ59697.1), 119 (RefSeq Accession No. NP_417544.5), 125 (GenBank Accession No. AAGO8191.1), 126 (GenBank Accession No.

Figure 51:
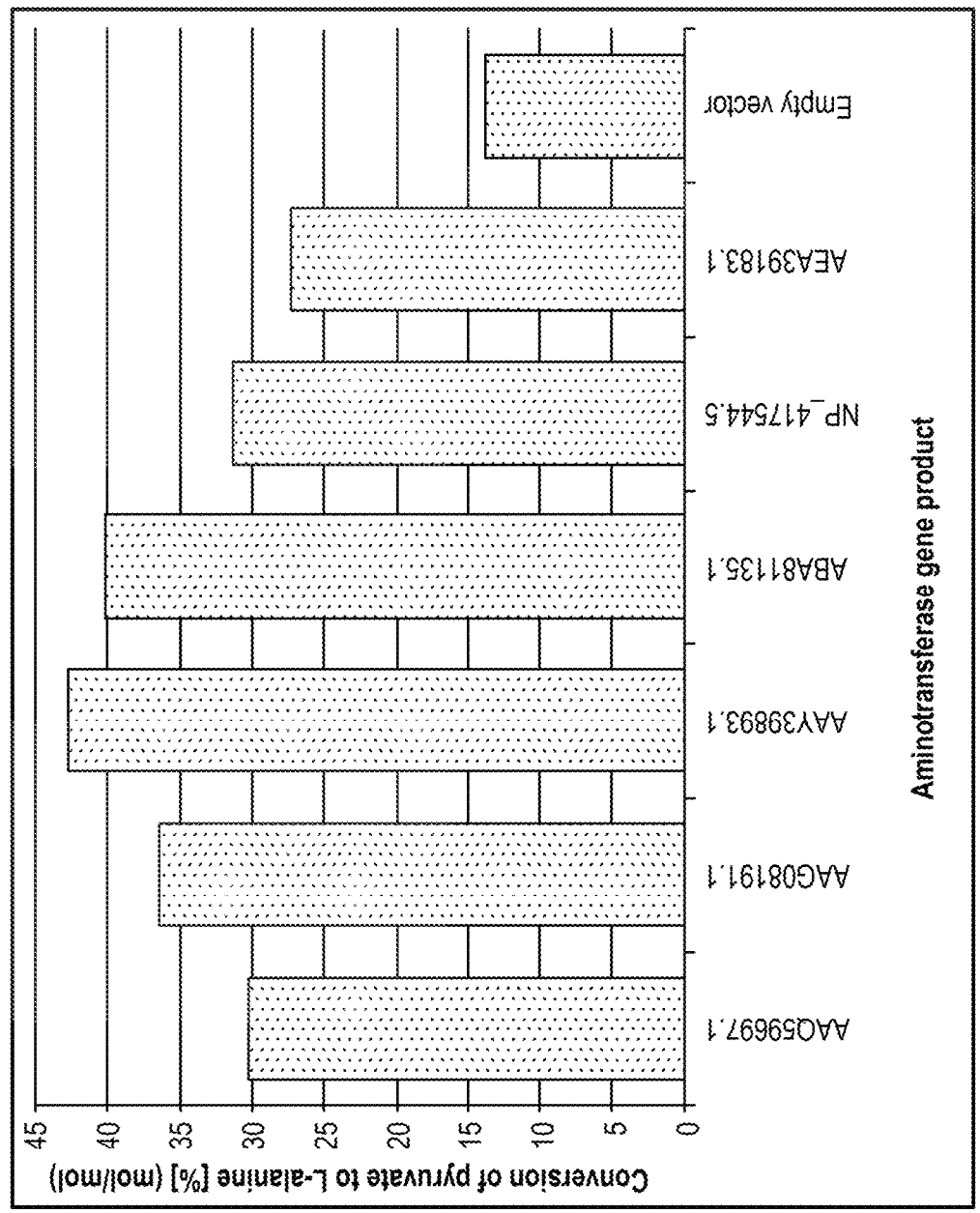
FIG. 51 is a bar graph of the percent conversion after 4 hours of pyruvate to L-alanine (mol/mol) as a measure of the aminotransferase activity for converting N7-acetyl-1,7-diaminoheptane to N7-acetyl-7-aminoheptanal relative to the empty vector control.

AAY39893.1), 127 (GenBank Accession No. ABA81135.1), and 128 (GenBank Accession No. AEA39183.1) accepted N7-acetyl-1,7-diaminoheptane as a substrate as confirmed against the empty vector control (see FIG. 51) and synthesized N7-acetyl-7-aminoheptanal as reaction product.

Given the reversibility of the aminotransferase activity (see Example 2), the gene products of SEQ ID NOs: 116, 119, 125, 127, and 128 accept N7-acetyl-7-aminoheptanal as substrate forming N7-acetyl-1,7-diaminoheptane.

Example 9

Enzyme Activity of Carboxylate Reductase Using 7-Oxoheptanoate as a Substrate and Forming Heptanedial The N-terminal His-tagged carboxylate reductase of SEQ ID NO: 38 (GenBank Accession No. ADG98140.1) (see Example 4) was assayed using 7-oxoheptanoate as substrate. The enzyme activity assay was performed in triplicate in a buffer composed of a final concentration of 50 mM HEPES buffer (pH=7.5), 2 mM 7-oxoheptanoate, 10 mM $MgCl_2$, 1 mM ATP and 1 mM NADPH. The enzyme activity assay reaction was initiated by adding purified carboxylate reductase and phosphopantetheine transferase or the empty vector control to the assay buffer containing the 7-oxoheptanoate and then incubated at room temperature for 20 min. The consumption of NADPH was monitored by absorbance at 340 nm. The enzyme only control without 7-oxoheptanoate demonstrated low base line consumption of NADPH. See FIG. 42.

Figure 46:
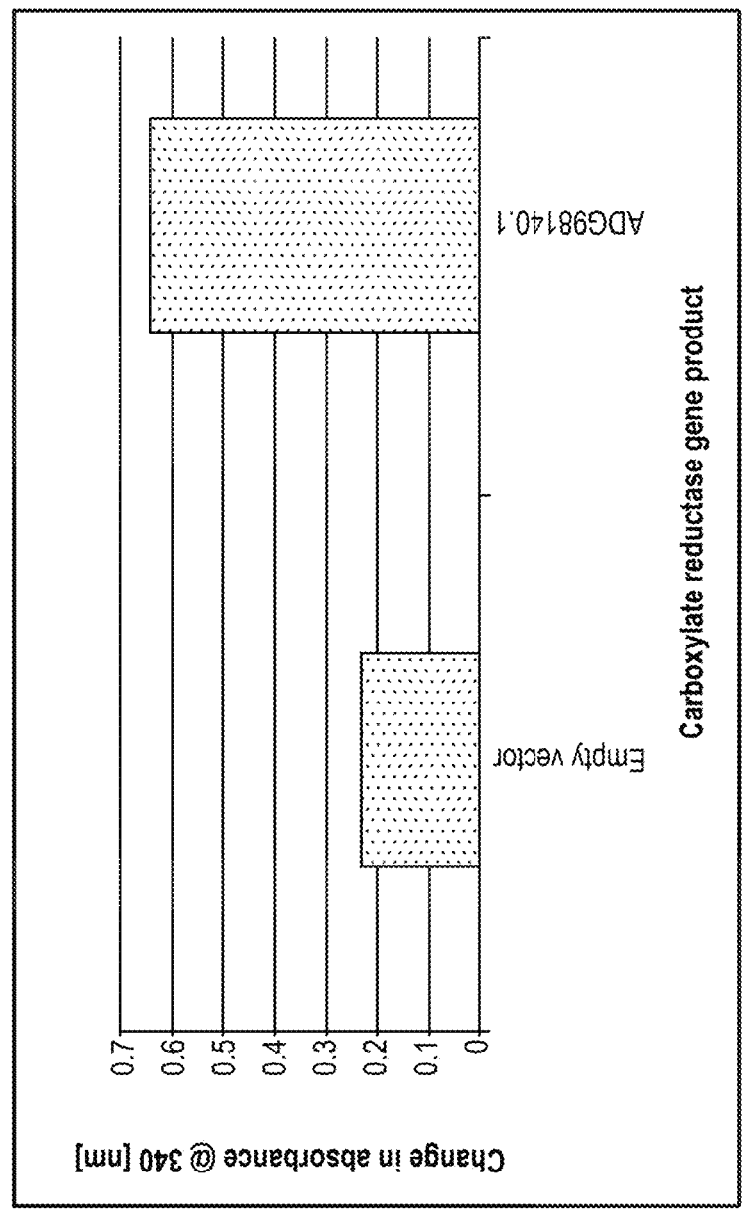
FIG. 46 is a bar graph of the change in absorbance at 340 nm after 20 minutes, which is a measure of the consumption of NADPH and activity of carboxylate reductases for converting 7-oxoheptanoate to heptanedial relative to the empty vector control.

The gene product of SEQ ID NO: 38, enhanced by the gene product of sfp, accepted 7-oxoheptanoate as substrate as confirmed against the empty vector control (see FIG. 46) and synthesized heptanedial.

Example 10

Enzyme Activity of an Esterase Using Monomethyl Heptanedioate as a Substrate and Forming Heptanedioic Acid A nucleotide sequence encoding a C-terminal His-tag may be added to the gene from *Bacillus subtilis* encoding the esterase of SEQ ID NO: 50 (*NCBI Reference Sequence*: NP_388108.1) such that a C-terminal HIS tagged esterase is produced. The resulting modified gene is cloned into a pET28b+ expression vector under control of the T7 promoter and the expression vector is transformed into a BL21[DE3] *E. coli* host. The resulting recombinant *E. coli* strain can be cultivated at 37° C. in a 500 mL shake flask culture containing 100 mL LB media and antibiotic selection pressure, with shaking at 230 rpm. Each culture is induced overnight at 18° C. using 0.3 mM IPTG.

The pellet from each induced shake flask culture can be harvested via centrifugation. Each pellet is resuspended and lysed via sonication. The cell debris is separated from the supernatant via centrifugation. The esterase can be purified from the supernatant using Ni-affinity chromatography, buffer exchanged and concentrated into 20 mM HEPES buffer (pH=7.5) via ultrafiltration and stored at 4° C.

Enzyme activity assays converting monomethyl heptanedioate to heptanedioic acid are performed in triplicate in a buffer composed of a final concentration of 25 mM Tris-HCl buffer (pH=7.0) and 5 [mM] monomethyl heptanedioic acid. The enzyme activity assay reaction is initiated by adding esterases to a final concentration of 10 [μM] to the assay buffer containing the monomethyl heptanedioate and incubated at 30° C. for 1 h, with shaking at 250 rpm. The formation of heptanedioic acid can be quantified via LC-MS.

In this set of esterase assays, a horse liver esterase (see, e.g., Craig et al., *J. Am. Chem. Soc.*, 1958, 80 (7), 1574-1579) and an esterase from *Streptomyces diastatochromogenes* (see, e.g., estA from *Streptomyces diastatochromogenes* classified under EC 3.1.1.1 (UniProtKB access number Q59837), among other esterases, affected the methyl ester hydrolysis of a $C_7$ compound.

Example 11

Production of Heptanedioic Acid in Genetically Modified *Escherichia coli* (K12) Strains S-Adenosyl-methionine (SAM)-dependent methyltransferases (MTases) catalyse the transfer of methyl groups from SAM to a large variety of acceptor substrates ranging from small metabolites to bio-macromolecules. See, e.g., Struck et al., 2012, *Chembiochem.*, 13(18):2642-55; see also FIGS. 1-3.

Figure 53:
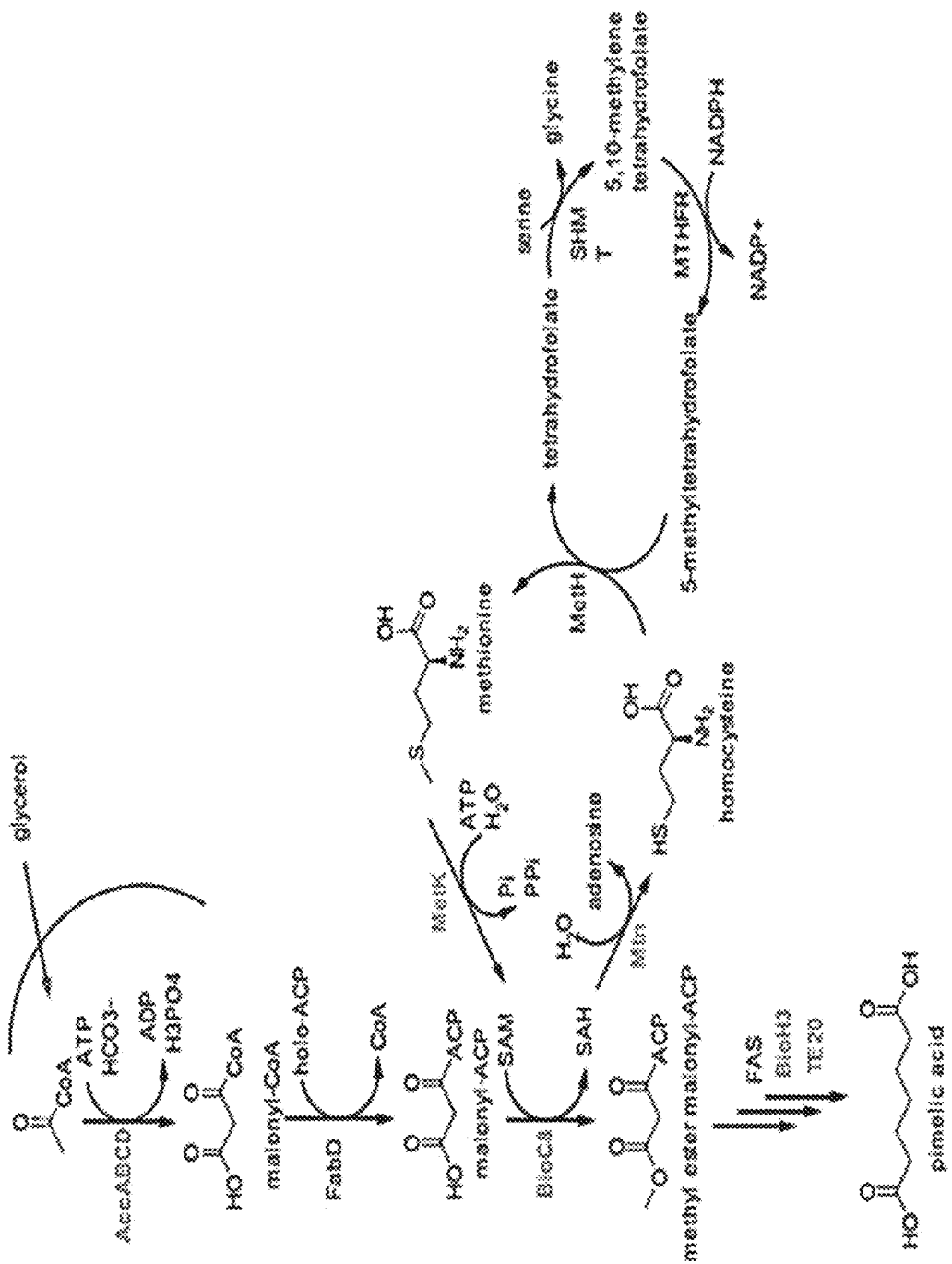
FIG. 53 illustrates representative factors and pathways involved in the S-Adenosyl-methionine (SAM) cycle.

Many factors involved in the SAM cycle may function to regulate the initial step of adding the methyl shield to propanedioyl-CoA or propanedioyl-[acp], which ultimately contribute to the altered production of heptanedioic acid. For example, MetK encodes for an enzyme that synthesizes SAM. Mtn encodes for 5'-Methylthioadenosine nucleosidase, and mutants of Mtn accumulate 5'-deoxyadenosine and have impaired biotin synthase activity. On the other hand, metJ encodes a SAM co-repressor that represses the SAM biosynthetic enzymes. MetJ represses expression of genes involved in methionine biosynthesis and is activated by increased levels of SAM. See, e.g., FIG. 53 for an illustration of representative factors involved in the SAM cycle.

The *Escherichia coli* (K12) strains carrying deletion in metJ, and/or expression in metK and Mtn (see FIG. 54) were obtained following standard protocols to prepare genetically modified *Escherichia coli* (K12) strains. Strains with Acc were selected to allow comparison to no MetK/Mtn and AfadE backgfound. Acc was selected to avoid propanedioyl-CoA being limited as an increase of SAM was expected.

Figure 57:
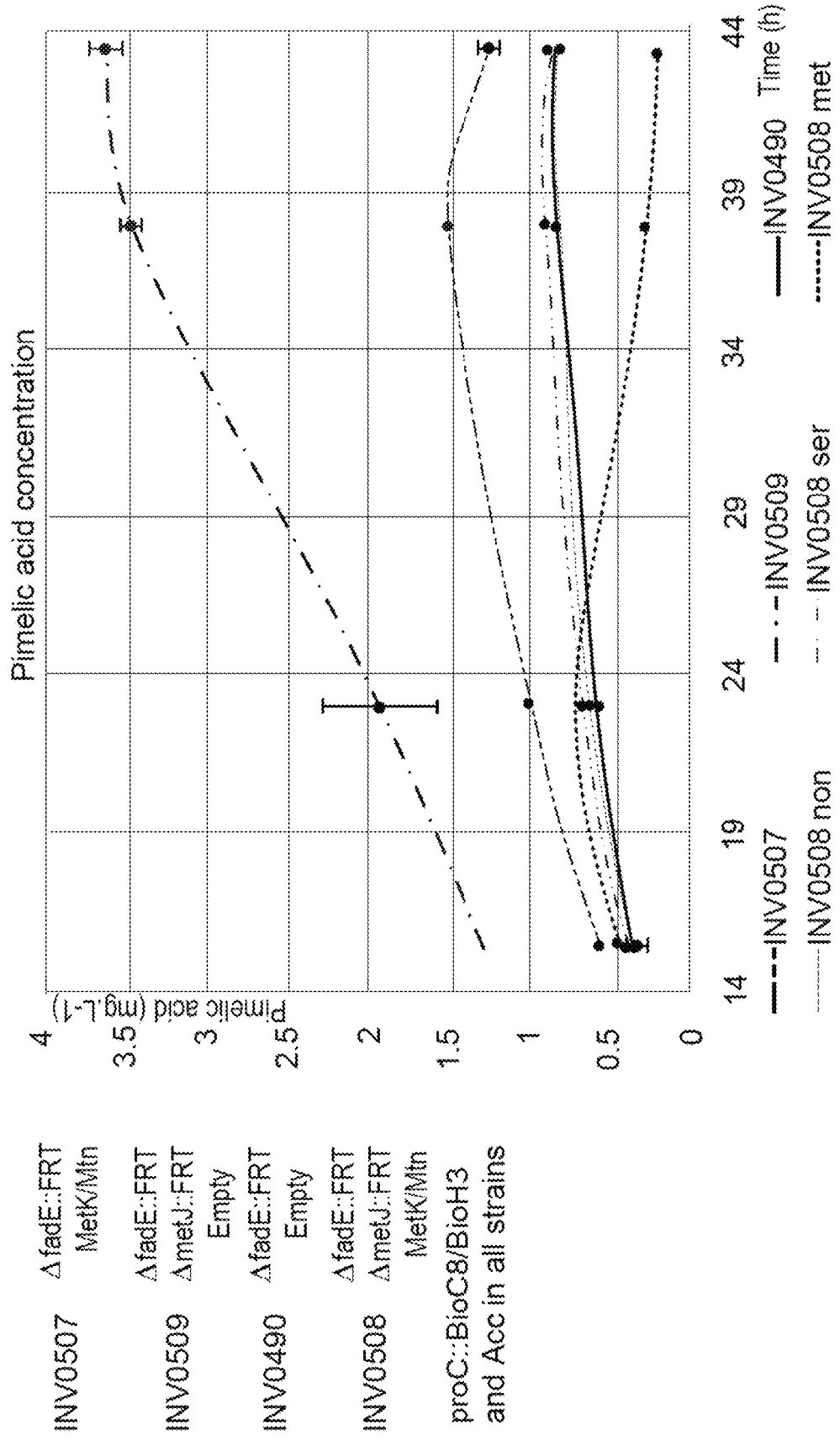
FIG. 57 is a bar graph of the production of heptanedioic acid in genetically modified *Escherichia coli* (K12) strains having one or more modifications in proteins involved in the initial step of adding a methyl shield to propanedioyl-CoA or propanedioyl-[acp].

The mutant strains were tested for heptanedioic acid production in shake flask experiments (see FIGS. 55 and 56 for assay conditions and comments). The formation of heptanedioic acid was quantified via LC-MS. The strains with expression in metK and Mtn (INV0507) led to negligible increase in heptanedioic acid. Furthermore, deletion of metJ coupled with expression of metK and Mtn (INV0508), did not lead to an increase in heptanedioic acid production. Unexpectedly, deletion in metJ by itself (INV0509) increased the production of heptanedioic acid. Specifically, the data shows an increase in heptanedioic acid concentration from <1 mg/L (in the non-deletion strain) to around 3.5 mg/L (in the metJ deletion strain). See FIG. 57. Addition of serine showed less heptanedioic acid despite better growth at 38 h.

Figure 59:
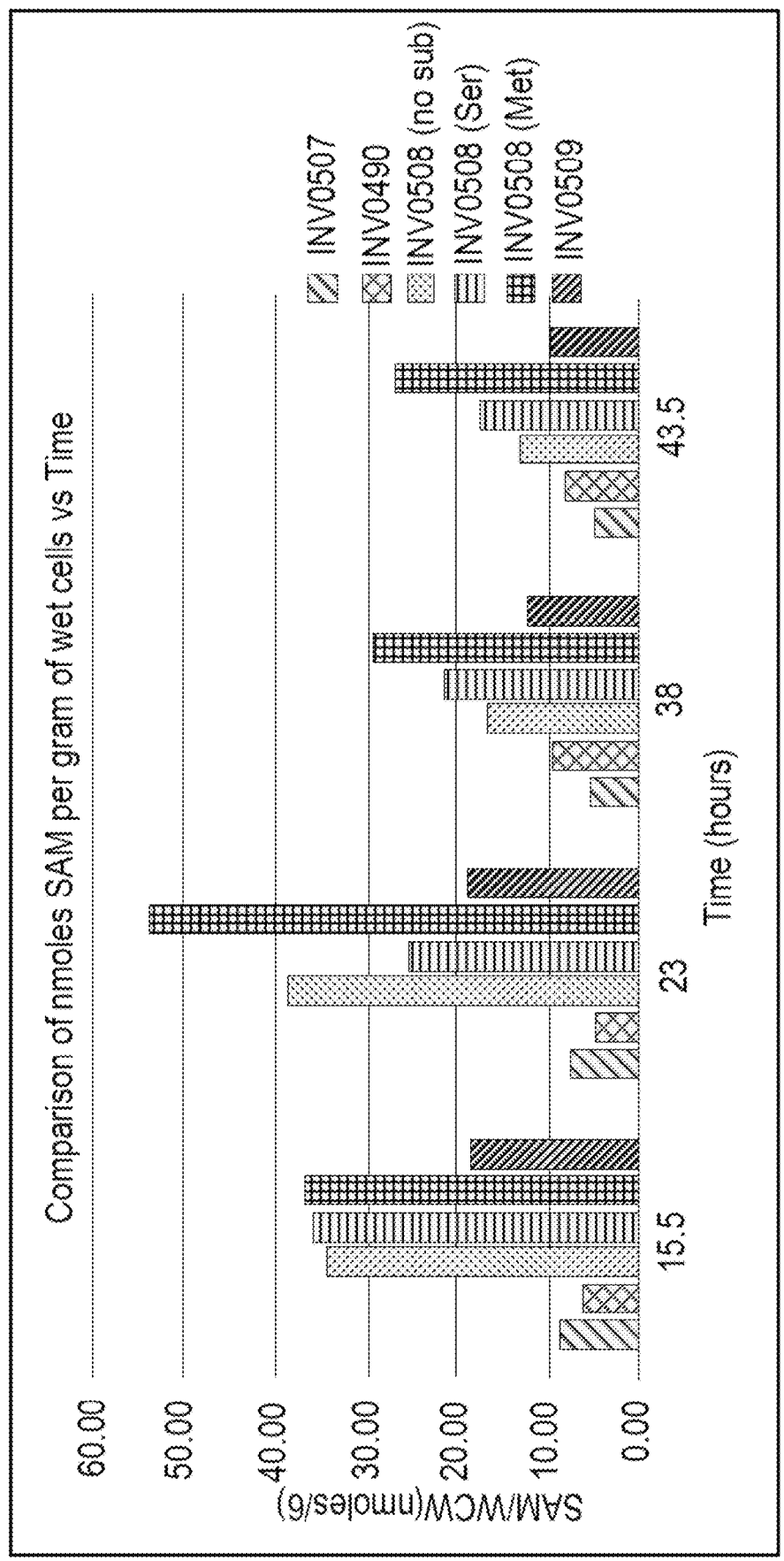
FIG. 59 is a bar graph of the production of SAM/g wet cell weight in genetically modified *Escherichia coli* (K12) strains having one or more modifications in proteins involved in the initial step of adding a methyl shield to propanedioyl-CoA or propanedioyl-[acp].

Furthermore, HPLC was used to determine the S-adenosyl-L-methionine (SAM) and S-adenosyl-L-homocysteine (SAH) levels, which provides good separation and excellent detection limits and linear range (see, e.g., Wang et al, J Chromatogr B Biomed Sci Appl. 2001, 62(1):59-65; see also FIG. 58). Intracellular SAM was detected in all samples, and no SAH was detected by HPLC. For SAM levels, there is an increase from around 5-10 nmoles SAM/g wet cell weight (in the non-deletion strain) to 10-20 nmoles SAM/g wet cell weight (in the metJ deletion strain). This depends on the timepoint but the metJ deletion strain always produces more SAM. INV0508 supplemented with methionine resulted in the highest SAM levels (29.6 nmoles/g WCW at t=38h, 42% higher vs. no substrate; and 27% higher vs. serine feed), indicating that met$^J$ deletion coupled with expression of metK and Mtn boots SAM production. Furthermore, supplementation of serine/methionine increased SAM levels but there was no correlation to increase in heptanedioate yield. See FIGS. 57 and 59.

Example 12A

In Vitro and In Vivo Thioesterase Activity Screening 1,457 thioesterases were screened in a cell lysate in vitro assay for their ability to produce heptanedioate from heptanedioyl-ACP. In addition, 1,322 thioesterases were screened for their ability to produce monomethyl heptanedioate from heptanedioyl-ACP methyl ester in a cell lysate in vitro assay. Among the enzymes screened, seventy-six thioesterases (5.2% of enzymes screened) were identified as being able to carry out hydrolysis of heptanedioyl-ACP, and 147 thioesterases (11.1% of enzymes screened) were identified as being able to carry out the hydrolysis of heptanedioyl-ACP methyl ester.

The thioesterase library was received from Twist in IPTG-inducible T7-expression vectors and transformed into T7Express lysY/Iq. The resulting strains were induced with 0.4 mM IPTG, incubated overnight at 30° C. in 384-well plates, and lysed with Bugbuster containing Benzonase and Lysozyme. The cell lysates were separately screened for their ability to carry out the hydrolysis of heptanedioyl-ACP or heptanedioyl-[acp] methyl ester. Each thioesterase transformant strain was analyzed using biological duplicates (i.e., two colonies from each transformant). Activity was assessed by incubating the cell lysates in assay solution (50 mM tris pH 7.9, 100 mM NaCl, 2% v/v glycerol, 500 µM DTNB, 0.33 mM acyl-ACP substrate) in 384-well plates at 30° C. for 30 min. The absorbance of the wells was then measured at 410 nm. Data was analyzed by comparing to negative controls (gfp expression strain and vector-only) and a positive control (Invista TE8 from *Clostridium perfringens*). Data were plotted in % activity compared to the negative control samples in that plate.

Figure 60:
FIG. 60 illustrates plasmids used for genetically modified *Escherichia coli* strains for in vivo thioesterase activity screens.

Thioesterases showing activity (judged as >10% "improvement" or % increase in Abs410 over the negative controls) were selected for further screening in vivo. A 175-member thioesterase library on IPTG-inducible T5-p15a expression vectors was co-transformed with BioC from *Serratia marcescens* (UniprotKB Accession No. P36571 (SEQ ID NO: 165)) expressed on a L-rhamnose inducible P(Rha)-pBR expression vector into both MG1655 rph+ AbioH and MG1655 rph+ AbioF. The plant thioesterase FatB2 from *Cuphea hookeriana* (UniprotKB Accession No. Q39514) was used as a positive control. FatB2 is a fatty acid acyl-ACP thioesterase with specificity toward $C_8$-$C_{10}$ carbon chain lengths. Overexpression of FatB2 adversely affected cell growth. See FIG. 60 for plasmids.

The resulting strains were incubated in 0.5 mL of terrific broth (TB) supplemented with 1 mM IPTG and 2 mM L-rhamnose were added at the beginning of the experiment as inducers. The cultures were incubated overnight in 96-well deep well plates at 37° C. in a shaking incubator. The cells were pelleted and culture supernatants were analyzed by LC-MS to determine the concentration of heptanedioate and monomethyl heptanedioate. Thioesterases active on heptanedioyl-ACP were detected in the AbioF strain via production of heptanedioate, and thioesterases active on methyl-heptanedioyl-ACP were detected via production of monomethyl heptanedioate in the AbioH strain, with impact determined as a percentage improvement over negative control.

Thioesterases for which no monomethyl heptanedioate production was detected scored as −100 improvement over negative control. Screening in a AbioH strain enabled approximately 14 mg/L of monomethyl heptanedioate production with FatB2 expression, about 10 mg/L higher than the negative control. Among the 146 thioesterases screened for impact on monomethyl heptanedioate production, four appeared to be promising and had a lower impact on cell growth than the positive control FatB2: UniProtKB Accession No. E4L0C9 (SEQ ID NO: 102); UniProtKB Accession No. A0A0B4Y4H4 (SEQ ID NO: 73); UniProtKB Accession No. F2JLT2 (SEQ ID NO: 74); and UniProtKB Accession No. A0A0B3WUQ1 (SEQ ID NO: 72). SEQ ID NO: 72 yielded an average of 48 mg/L monomethyl heptanedioate when the recombinant host expressing the thioesterase was grown in TB supplemented with 1 mM IPTG and 2 mM L-rhamnose. Further supplementation with serine and methionine appeared to inhibit monomethyl heptanedioate production.

Example 12B

Additional Thioesterase Activity Screening

Thioesterase enzymes were selected using sequence similarity networks to sample a phylogenetically diverse set from the UniProtKB database and the ThYme database. From a selection of 1,956 enzymes, 1,457 thioesterases were screened on heptanedioyl-ACP, with 76 hits, and 1,322 thioesterases were screened on heptanedioyl-ACP methyl ester, with 147 hits. Thioesterases corresponding to UniProtKB Accession Nos. A0A084JBW2 (SEQ ID NO: 88), D4YGM6 (SEQ ID NO: 95), R6RDZ9 (SEQ ID NO: 182), R6XLC3 (SEQ ID NO: 183), M1Z1V0 (SEQ ID NO: 184), $C_7$ML86 (SEQ ID NO: 91), D0BKN0 (SEQ ID NO: 185), P44886 (SEQ ID NO: 186), and R5FQ35 (SEQ ID NO: 187) were notable for their activity toward heptanedioyl-ACP. Thioesterases corresponding to UniProtKB Accession Nos. A0A084JBW2 (SEQ ID NO: 88), B81625 (SEQ ID NO: 89), G7V8P3 (SEQ ID NO: 76), $C_7$ML86 (SEQ ID NO: 91), F5YIQ3 (SEQ ID NO: 92), A3DJY9 (SEQ ID NO: 75), H2FZ27 (SEQ ID NO: 93), P0A8Z3 (SEQ ID NO: 60), A0A0D3V4E9 (SEQ ID NO: 94), and A4A3N9 (SEQ ID NO: 61) were notable for their activity toward heptanedioyl-ACP methyl ester. When the top 150 hits were subsequently screened in vivo, enzymes corresponding to UniprotKB Accession Nos. Q07792 (SEQ ID NO: 188), A0A0F7JXA5 (SEQ ID NO: 189), K5D7V3 (SEQ ID NO: 190), A0A0M9UHQ1 (SEQ ID NO: 191), A0A0F9W7B7 (SEQ ID NO: 86), A0A0C3EBX5 (SEQ ID NO: 192), A6D1N2 (SEQ ID NO: 82), A0A0B7DFD2 (SEQ ID NO: 193), A0A0B4Y4H4 (SEQ ID NO: 73), A4VL40 (SEQ ID NO: 194), E1WY53 (SEQ ID NO: 195), F7Z10 (SEQ ID NO: 108), and E1SPF5 (SEQ ID NO: 85) displayed considerable activity toward heptanedioyl-ACP, while enzymes corresponding to UniProtKB Accession Nos. E4L0C9 (SEQ ID NO: 102), A0A0B3WUQ1 (SEQ ID NO: 72), A3DJY9 (SEQ ID NO: 75), B1ZXQ1 (SEQ ID NO: 78), A0A0B4Y4H4 (SEQ ID NO: 73), A0A0F7M706 (SEQ ID NO: 58), F2JLT2 (SEQ ID NO: 74), D5XAN2 (SEQ ID NO:

79), G7V8P3 (SEQ ID NO: 76), D6E2B1 (SEQ ID NO: 68), R6Q7V8 (SEQ ID NO: 80), D2TLW8 (SEQ ID NO: 81), and E1RAP4 (SEQ ID NO: 77) showed activity toward heptanedioyl-ACP methyl ester.

Example 13

Selection of Aminotransferases with Specificity for Methyl 7-Oxoheptanoate Using Purified Enzymes N-terminal His-tagged aminotransferases in T7 expression vectors were expressed in *E. coli* overnight at 30° C. for 16 hours. Cell pellets were resuspended in 50 mM HEPES pH 7.5, 100 mM NaCl, and 1 mM PLP. Lysis was performed using a microfluidizer and lysates were purified using Ni-NTA resin. A five-fold excess of pyruvate was added to the purified protein to convert any PMP present in the active site to PLP. Pyruvate and imidazole were removed from purified protein by dialysis against 50 mM HEPES pH 7.5, 100 mM NaCl.

For titrations with 7-oxoheptanoate or methyl 7-oxoheptanoate, a coupled assay with lactate dehydrogenase was used to characterize activity using the pyruvate generated by the deamination of alanine. Reactions contained 100 mM HEPES pH 7.5, 100 mM NaCl, 250 mM alanine, 0.8 mM NADH, 2.5 µg/ml lactate dehydrogenase, and 0.05 mg/ml of aminotransferase. Concentrations of 7-oxoheptanoate and methyl 7-oxoheptanoate were varied until rate saturation or substrate inhibition was observed.

Similarly, for titrations with alanine, a coupled assay with lactate dehydrogenase was used to characterize activity using the pyruvate generated by the deamination of alanine. Reactions contained 100 mM HEPES pH 7.5, 100 mM NaCl, 2 mM 7-oxoheptanoate, 0.8 mM NADH, 2.5 µg/ml lactate dehydrogenase, and 0.05 mg/ml of aminotransferase. Concentrations of alanine were varied from 0 mM to 200 mM.

In addition, to test glutamate and aspartate as amine donors, a coupled assay with glutamate dehydrogenase was used to characterize activity with glutamate using the α-ketoglutarate generated by the deamination of glutamate. A coupled assay with malate dehydrogenase was used to characterize activity with aspartate using the oxaloacetate generated by the deamination of aspartate. Reactions contained 100 mM HEPES pH 7.5, 100 mM NaCl, 2 mM 7-oxoheptanoate, 100 mM aspartate or glutamate, 0.8 mM NADH, 0.4 mg/ml glutamate dehydrogenase or 0.15 mg/ml malate dehydrogenase, and 0.05 mg/ml of aminotransferase.

Example 14A

In Vivo Aminotransferase Activity Screening

A 165-member aminotransferase library from Twist on IPTG-inducible T7- pUC expression vectors was co-transformed into T7 Express lysY/Iq with a constitutive expression pJ23150-derived plasmid bearing the phosphopantetheinyl transferase sfp from *Bacillus subtilis*, CAR_Srot from Invista and BioC from *Serratia marcescens* (UniprotKB Accession No. P36571 (SEQ ID NO: 165)). The resulting strains were incubated in 0.5 ml of rich media (terrific broth or LB containing 8% glycerol) supplemented with 0.4 mM IPTG and received 1 g/L monomethyl heptanedioate, 1 g/L heptanedioate, or no organic acid addition, depending on the experiment. Following incubation overnight at 37° C. in a shaking incubator, cells were pelleted and the supernatants were analyzed using LC-MS for 7-aminoheptanoate or monomethyl 7-aminoheptanoate. A *Vibrio fluvialis* aminotransferase (UniProtKB Accession No. F2XBU9 (SEQ ID NO: 128)) was used as a positive control.

Example 14B

Additional Aminotransferase Activity Screening

Aminotransferase enzymes were selected using sequence similarity networks to sample a phylogenetically diverse set from the UniProtKB database. Candidates were selected from each cluster, with 1,229 enzymes selected as being feasible for the desired reaction. Among these feasible enzymes, 167 were active toward 7-oxoheptanoate. Twelve of the top performing aminotransferases from in vitro analysis were taken forward for detailed kinetic analysis. Among these enzymes, aminotransferases corresponding to UniProtKB Accession Nos. A0A086YIZ0 (SEQ ID NO: 121), A0A011UWB9 (SEQ ID NO: 131), A0A086MKC4 (SEQ ID NO: 133), A0A0E9ZHQ3 (SEQ ID NO: 123), A0A0H1A7R9 (SEQ ID NO: 134), B9L0N2 (SEQ ID NO: 117), H01025 (SEQ ID NO: 124), J2TM48 (SEQ ID NO: 137), and Q7NWG4 (SEQ ID NO: 116) had a catalytic efficiency ($K_{cat}$/km) favoring methyl 7-oxoheptanoate, whereas aminotransferases corresponding to UniProtKB Accession Nos. D7CVJ6 (SEQ ID NO: 130), A0A0H1AH98 (SEQ ID NO: 122), D7A1Z2 (SEQ ID NO: 135), G7Z3P2 (SEQ ID NO: 136), and K2KXB1 (SEQ ID NO: 138) had a preference for 7-oxoheptanoate. In parallel, 120 aminotransferases were also screened in vivo for the conversion of 7-oxoheptanoate to 7-aminoheptanoate, and thirty of these generated more 7-aminoheptanoate than the positive control (UniProtKB Accession No. F2XBU9 (SEQ ID NO: 128)). Examples of aminotransferases with higher 7-aminoheptanoate yields include enzymes corresponding to UniProtKB Accession Nos. A0A0E9ZHQ3 (SEQ ID NO: 123), B6ISI5 (SEQ ID NO: 168), A0A0F9UFF8 (SEQ ID NO: 169), C7LZG4 (SEQ ID NO: 170), I3TH77 (SEQ ID NO: 171), V7D492 (SEQ ID NO: 172), A0A0C6G014 (SEQ ID NO: 173), G3BAK1 (SEQ ID NO: 174), A0A081B6K8 (SEQ ID NO: 175), R5HDC3 (SEQ ID NO: 176), A3U3W9 (SEQ ID NO: 177), A0A086YIZ0 (SEQ ID NO: 121), K2KXB1 (SEQ ID NO: 138), B9L0N2 (SEQ ID NO: 117), A0A0H1AH98 (SEQ ID NO: 122), A0A059IS31 (SEQ ID NO: 178), D7VKX2 (SEQ ID NO: 179), F2XBU9 (SEQ ID NO: 128), F5Y1J0 (SEQ ID NO: 180), and A0A061M4Q7 (SEQ ID NO: 181).

Example 15

Carboxylate Reductase Activity Screening with Purified Enzymes

N-terminal, His-tagged carboxylate reductases were co-expressed with a phosphopantetheine transferase (sfp) in T7 expression vectors in *E. coli* overnight at 28 C for 16 hours. The cell pellets were re-suspended in 50 mM potassium phosphate pH 7.5, 300 mM NaCl, 10% (w/v) glycerol. Lysis was performed using a microfluidizer (two passes at 10,000 PSI). The lysates were clarified by centrifugation (12,000×g for 1 hour) and purified using fast protein liquid chromatography (FPLC) with Ni-NTA resin employing a gradient of 0 to 500 mM imidazole. Peak fractions were analyzed for activity, and purity was confirmed via SDS-PAGE (95% pure).

For titrations with heptanedioate/monomethyl heptanedioate, 7-oxoheptanoate/methyl 7-oxoheptanoate, and 7-aminoheptanoate/monomethyl 7-aminoheptanoate, the reaction mixtures contained 100 mM Tris pH 7.5, 1 mM EDTA, 2 mM β-mercaptoethanol, 1 mM MgCl$_2$, 10% (w/v) Glycerol, 0.5 mM NADPH, 1 mM ATP, and 5 μg of carboxylate reductase (co-expressed with phosphopantetheine transferase). The reactions were monitored by following the decrease in absorbance at 340 nm. Concentrations of the substrates were varied until rate saturation was observed. For methyl 7-oxoheptanoate, 7-aminoheptanoate, and monomethyl-7-aminoheptanoate, the substrates were titrated up to 20 mM without detecting any activity.

For reactions to test degree of phosphopantetheinylation, carboxylate reductases and carboxylate reductases co-expressed with phosphopantetheine transferase were incubated with phosphopantetheine transferase and 1 mM acetyl-CoA for 1 hour at 37° C. The activity of the enzymes were then determined by adding 5 μL of each mixture to 95 μL of 100 mM Tris pH 7.5, 1 mM EDTA, 2 mM β-mercaptoethanol, 1 mM MgCl$_2$, 10% (w/v) Glycerol, 0.5 mM NADPH, 1 mM ATP, and 5 mM monomethyl heptanedioate. The reactions were monitored by following the decrease in absorbance at 340 nm.

Example 16A

In Vivo and In Vitro Carboxylate Reductase Activity Screening

To screen carboxylate reductases in vitro, a 570-member carboxylate reductase library from Twist on IPTG-inducible T7- pUC expression vectors was co-transformed into T7 Express lysY/Iq with the phosphopantetheinyl transferase sfp from *Bacillus subtilis* on a T7-pCDF expression vector. The Invista CAR Srug and Srug69 were used as positive controls. Biological duplicates of the resulting strains were incubated in 0.5 ml of terrific broth supplemented with 0.4 mM IPTG in 96-well deep well plates. The plates were incubated overnight at 30° C. in a shaking incubator. 150 μl of the cultures were transferred to new 96-well deep well plates to which 150 μL BugBuster supplemented with lysozyme (1 μL/mL), benzonase (1 L/mL), and PMSF (0.5 mM) was added and incubated for 10 min at room temperature. The cell debris was pelleted and 10 μL of the supernatants was assayed for activity.

In addition, NADPH oxidation assays were performed on the supernatants in 96-well plates with 100 μL reaction volumes. The assay mixture contained: 50 mM HEPES pH 7.5, 10 mM MgCl$_2$, 10% glycerol, 1 mM ATP, 0.2 mM NADPH, 5 mM monomethyl heptanedioate or heptanedioate. The assay was performed at 37° C. and readings at 340 nm were taken at 30, 120, and 180 minutes.

To screen carboxylate reductases in vivo, a 497-member carboxylate reductase library from Twist on IPTG-inducible T7- pUC expression vectors was co-transformed into T7 Express lysY/Iq with the phosphopantetheinyl transferase sfp from *Bacillus subtilis* on a T7-pCDF expression vector. Biological duplicates of the resulting strains were incubated in 0.5 mL of terrific broth containing either 1 g/L heptanedioate or 1 g/L monomethyl heptanedioate and supplemented with 0.4 mM IPTG in 96-well deep well plates. The plates were incubated for 30 h at 30° C. in a shaking incubator. The cells were then pelleted, and culture supernatants from the same strains in media containing either heptanedioate or monomethyl heptanedioate were combined. The combined supernatants were analyzed by LC-MS to determine the concentration of heptanedioate and monomethyl heptanedioate. Carboxylate reductase activity on heptanedioate or monomethyl heptanedioate was reflected by consumption of the respective substrate in the medium.

Example 16B

Additional Carboxylate Reductase Activity Screening

Carboxylate reductase enzymes were selected using sequence similarity networks to sample a phylogenetically diverse set from the UniProtKB database. Selecting candidates from each cluster, a total of 541 enzymes were screened in vivo to convert monomethyl heptanedioate and heptanedioic acid. Enzymes corresponding to UniProtKB Accession Nos. A0A0G4ID64 (SEQ ID NO: 196), A0A0H5CAG1 (SEQ ID NO: 197), W3XHR4 (SEQ ID NO: 198), Q18660 (SEQ ID NO: 199), I7MB41 (SEQ ID NO: 200), A0A087SHC7 (SEQ ID NO: 201), A0A068SDQ8 (SEQ ID NO: 202), A0A0K1PNT5 (SEQ ID NO: 203), A0A0J9XGX9 (SEQ ID NO: 204), W6MHS7 (SEQ ID NO: 205), and G4YTV4 (SEQ ID NO: 206) preferred acting upon heptanedioic acid to form 7-oxoheptanoate; many of these enzymes displayed little activity for monomethyl heptanedioate. However, the tested enzymes with the most monomethyl heptanedioate activity included enzymes corresponding to UniProtKB Accession Nos. Q1ZXQ4 (SEQ ID NO: 207), F1KXI1 (SEQ ID NO: 208), A0A034UK40 (SEQ ID NO: 209), A0A0C7BIS0 (SEQ ID NO: 210), Q4N8F1 (SEQ ID NO: 211), A0A0M3J210 (SEQ ID NO: 212), T1EG09 (SEQ ID NO: 213), A0A0F4ES51 (SEQ ID NO: 214), and A0A0H2RRC5 (SEQ ID NO: 215).

Example 17

Alcohol Dehydrogenase Activity Screening

Sixty-eight potential alcohol dehydrogenase genes from *E. coli* were cloned into IPTG-inducible T5-expression vectors. The enzyme library was transformed into MG1655 rph+ΔybbO ΔyahK Δahr ΔadhP ΔyqhD ΔyiaY. Biological triplicates of strains were grown in 0.5 mL terrific broth supplemented with 0.5 mM IPTG for induction. The culture incubation was performed in 96-well deep well plates for 4 h at 37° C. in a shaking incubator. The cells were pelleted by centrifugation at 4° C., and the supernatant was removed. The cell pellets were resuspended in 200 μL BugBuster supplemented with lysozyme (1 μL/mL), benzonase (1 μL/mL), and PMSF (0.5 mM) and incubated for 10-20 min at room temperature, after which the cell debris was pelleted, leaving the supernatant as the crude extract. Assays were performed on the supernatants in 96-well plates in 200 μL reactions.

The assay mixture contained 50 mM MOPS, 0.2 mM NAD(H) or NADPH, and 10 μL crude extract. Reactions were initiated by the addition of 2 mM 7-oxoheptanoate. Prior to initiation of the assay, the enzymes were equilibrated at 37° C. for 3 min. After initiation, the decrease or increase in absorbance monitored at 340 nm was measured continuously for 3 min. Each plate was measured again after 30 min has passed.

Other Embodiments

It is to be understood that, while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (215 sequences)

SEQ ID NO: 1 - protein, 151 aa, Escherichia coli (strain K12)
MTTNTHTLQIEEILELLPHRFPFLLVDRVLDFEEGRFLRAVKNVSVNEPFFQGHFPGKPIFPGVLILEAMAQATGILAFKSVGKLEPGELYYFAGIDEARFKRPVVPGDQMIMEVTFEKTRRGLTRFKGVALVDGKVVCEATMMCARSREA

SEQ ID NO: 2 - protein, 753 aa, Staphylococcus aureus
MTINKVTVLGAGTMGAQLAALFVNAGLKVKLLDIVVDKNDPNLIAKKSYDKITDKKRPLLFDLNLASHLTYGNFDDDLVNDDADLYIEAVKEDIEIKHAVWQQVLQHAKEDALFATNTSGIPINAIAQAFNEKDQERFFGLHFFNPPRIMKLVELIPTSHTKESIILDVKNFAQNVLGKGVIVVNDVPGFVANRVGTQTMNDIMYRAEQHKISIVDVDALTGQAIGRPKTGTYALSDLVGLDIAVSVIKGMQQVPEETPYFHDVKIVNTLFDNGALGRKTKQGFYKKDKETKARLVYDVEKQDYVPVSQPQLPILNEFNKDLVHNLDTIFNAQDEAGLFLWETLRNNFYYSAINVPKATDDFRDIDRALVWGFNWKLGPFQLWDAMGYERVKTRMEDELGDLPQWISDLDGGFYKQDETIEYATPISHFVKDELWDKGDAKLSVTHDDQLLLKLQSKNNVITDEFNDALVDAIDLLENDHYTSMVIYADGNNFSVGANLFLMKKAHEDGLVDDVVAQSIDKLHYSFNRLKYSLKPVVTAVQGRALGGGCELVLYSPIVVAASETYIGLVEAGVGLLPSGGGLAEMADRILRTSHKFDDKQASMTKVLTNIAFAKVSTNAFEARRYGYLRDTDTIIFNTAQRVEVALKRAKYEAETNYIPNPRHQYIALGEDFKALIQGQLDAQRRGHFISDHDYHIALNIATILAGGDLPRNTFINQRYIQSLEKIGFIDLLKSKKSYERIAHMLKTGKPLRN

SEQ ID NO: 3 - protein, 246 aa, Cupriavidus necator
  Cupriavidus necator (strain ATCC 17699 / H16 / DSM 428 / Stanier 337)
MTQRIAYVTGGMGGIGTAICQRLAKDGFRVVAGCGPNSPRREKWLEQQKALGFDFIASEGNVADWDSTKTAFDKVKSEVGEVDVLINNAGITRDVVFRKMTRADWDAVIDTNLTSLFNVTKQVIDGMADRGWGRIVNISSVNGQKGQFGQTNYSTAKAGLHGFTMALAQEVATKGVTVNTVSPGYIATDMVKAIRQDVLDKIVATIPVKRLGLPEEIASICAWLSSEESGFSTGADFSLNGGLHMG

SEQ ID NO: 4 - protein, 282 aa, Clostridium acetobutylicum
  Clostridium acetobutylicum (strain ATCC 824 / DSM 792 / JCM 1419 / LMG 5710 / VKM B-1787)
MKKVCVIGAGTMGSGIAQAFAAKGFEVVLRDIKDEFVDRGLDFINKNLSKLVKKGKIEEATKVEILTRISGTVDLNMAADCDLVIEAAVERMDIKKQIFADLDNICKPETILASNTSSLSITEVASATKRPDKVIGMHFFNPAPVMKLVEVIRGIATSQETFDAVKETSIAIGKDPVEVAEAPGFVVNRILIPMINEAVGILAEGIASVEDIDKAMKLGANHPMGPLELGDFIGLDICLAIMDVLYSETGDSKYRPHTLLKKYVRAGWLGRKSGKGFYDYSK

SEQ ID NO: 5 - protein, 244 aa, Escherichia coli (strain K12)
MNFEGKIALVTGASRGIGRAIAETLAARGAKVIGTATSENGAQAISDYLGANGKGLMLNVTDPASIESVLEKIRAEFGEVDILVNNAGITRDNLLMRMKDEEWNDIIETNLSSVFRLSKAVMRAMMKKRHGRIITIGSVVGTMGNGGQANYAAAKAGLIGFSKSLAREVASRGITVNVVAPGFIETDMTRALSDDQRAGILAQVPAGRLGGAQEIANAVAFLASDEAAYITGETLHVNGGMYMV

SEQ ID NO: 6 - protein, 250 aa, Streptococcus pneumoniae
MNKRKCALITGSSRGVGKEVALRLAEKGYDIVINYARSKKAALETAEEIEAMGVKTLVVKANVGQPEKIKDMFQQIDETFGRLDVFVNNAASGVQRPIMDLEENHWDWTMNINAKALLFCGQEAAKLMEKNGGGHIVSISSLGSIRYLENYTVVGVSKAALEALTRYLSVELSQKNIVVNAVSGGAIDTDALKHFPNREELLEDAKKNTPAGRMVEIKDMVDSVEFLVSGKADMIRGQTIIVDGGRSLLV

SEQ ID NO: 7 - protein, 327 aa, Mycobacterium smegmatis (strain ATCC 700084 / mc(2)155)
MKQLILTKFGDPEDTVRLVDTPEPVAGPGKVLVRLEAAAINPSDLLLLKGKYLVHPELPAGVGAEGVGIVEAVGPEVDSNLVGKRVIVLPTYTYGTWSEKVVAAAHDVIEVPDADPQQLAMLSINPPTAHLLLDRFVNLQVGDWVGQTAANSAVGRYVTTLARRRGLKTLNIVRREDAVEDVRAAGGDVVVVSGPNLADDIKQALGGDRLSLVIDPLGGSAASDLIGALEFGGTAVAYASLTGTPMSVSSADLFGREVRLTGFWLGNWYASEPRHEIVDTLDYLARLIAEGVLHAPVEATYHLDDYLKAFTHARTAKRGGKILFTFE

SEQ ID NO: 8 - protein, 352 aa, Acinetobacter sp. NCIMB9871
MHCYCVTHHGQPLEDVEKEIPQPKGTEVLLHVKAAGLCHTDLHLWEGYYDLGGGKRLSLADRGLKPPLTLSHEITGQVVAVGPDAESVKVGMVSLVHPWIGCGECNYCKRGEENLCAKPQQLGIAKPGGFAEYIIVPHPRYLVDIAGLDLAEAAPLACAGVTTYSALKKFGDLIQSEPVVIIGAGGLGLMALELLKAMQAKGAIVVDIDDSKLEAARAAGALSVINSRSEDAAQQLIQATDGGARLILDLVGSNPTLSLALASAARGGHIVICGLMGGEIKLSIPVIPMRPLTIQGSYVGTVEELRELVELVKETHMSAIPVKKLPISQINSAFGDLKDGNVIGRIVLMHEN

SEQ ID NO: 9 - protein, 477 aa, Acinetobacter sp. NCIMB9871
MNYPNIPLYINGEFLDHTNRDVKEVFNPVNHECIGLMACASQADLDYALESSQQAFLRWKKTSPITRSEILRTFAKLAREKAAEIGRNITLDQGKPLKEAIAEVTVCAEHAEWHAEECRRIYGRVIPPRNPNVQQLVVREPLGVCLAFSPWNFPFNQAIRKISAAIAAGCTIIVKGSGDTPSAVYAIAQLFHEAGLPNGVLNVIWGDSNFISDYMIKSPIIQKISFTGSTPVGKKLASQASLYMKPCTMELGGHAPVIVCDDADIDAAVEHLVGYKFRNAGQVCVSPTRFYVQEGIYKEFSEKVVLRAKQIKVGCGLDASSDMGPLAQARRMHAMQQIVEDAVHKGSKLLLGGNKISDKGNFFEPTVLGDLCNDTQFMNDEPFGPIIGLIPFDTIDHVLEEANRLPFGLASYAFTTSSKNAHQISYGLEAGMVSINHMGLALAETPFGGIKDSGFGSEGGIETFDGYLRTKFITQLN

SEQ ID NO: 10 - protein, 460 aa, Rhodococcus sp. TK6
MGVYTTTDPATGEEVAQYPEISDAELDELIGRSAAAYRSWRTTPLEQRRAVLARAAEIHREQADELAALLTLEMGKPITQAKGEVALVASIYQYYADHAEEFMADEPLDIAGSGTAVVRTEAIGPLVGVMPRNYPFYQVARFAAPNIALGNTIILKHARNCPQSALALERVLTEAGLPDGVYLNAFISSAQVAAAIADPRIQGVSLTGSEKAGSAVGEVAGRHMKKCVLELGGSDPFIVLGDADVDAAASAAVVGRLGNGGQACTASKRFLVEEPVYDEFVRKFLDGMTGWQPSDPASPETKLGPLSSRSAVDELDELVQDAVSHGAEVLTGGDRPDEKGAYYPPTVLVGVTPEMRAYHEELFGPVVVVHRVGSLDEAIEAANDSPFGLSSSVFTSDPDKADRVAEELETGMVWINSTSKSSPDLPFGGVKRSGVGRELARFGFNEFANKKLVRNPGGKK

SEQ ID NO: 11 - protein, 475 aa, Sphingomonas macrogolitabida
MTRQNDIDFLGDFRMVIDGRTEGSEKTIEVINPATEQPVGHAPDCSADQLDAAIASARQAFMSWKATPIAERQALLRAIADRIESIVEPLALLLTREQGKPLADARGEILRATQWFRFYAEQDLPVGRHTEPGGQEVTVRRVPLGVVRAIAPWNYPISMALWKLAPALLAGNAVVLKPSPFTPLTTLKLCEALIDILPPGLVNALSGGDNLGPWISEHPGIDKIAFTGSTATGRAVMRSSAANLKRLTLELGGNDPAIVLPDVDVEETAGKLFWAAFRNNGQLCVAAKRIYVHDSIYDDFAAAIGKIARSTAPAPGEQEGAVLGPVQNRIQYDKVRGLIAASRAAGLGFLSEPGSFDGPGFFIAPTIIDNPPEDARIVQEEPFGPVVPLLRYHDIDEVIRRANESEYGLAASVWAKDADLAEEVAVRIESGTVWINTAHILSPSIPFSGRKQSGIGVENGKEVLLEYTGIQAIIR

SEQ ID NO: 12 - protein, 477 aa, Acinetobacter sp. NCIMB9871; identical to SEQ ID NO: 9

SEQ ID NO: 13 - protein, 460 aa, Rhodococcus sp. TK6; identical to SEQ ID NO: 10

SEQ ID NO: 14 - protein, 402 aa, Xanthomonas axonopodis pv. citri (strain 306)
MRRVVITGMGITSCLGNDLDTVSSALRESRSGITALPDHAEAGLRSQVGGAVALDLDSLIDRKLKRFMGDASAYAYLAMRDAIADAGLDAELVSGLRTGVIAGSGGGSSQWQVETADLLRNRGVRKVGPYMVPRTMCSSVSASLATAFKIRGLSYSLSAACATSAHCIGAAADLIRHGAQDVMFAGGGEELHWTMSVMFDAMGALSTGSNDRPAVASRPYDAQRDGFVIGSGGGMLVLEDYDHAIARGARIHAELLGYGVTSDGADMVAPSGEGAVRCMRMAMQGLQRPIDYLNTHGTSTPLGDVTELGAVREVFGDNVPPLSSTKGLSGHSLGAASVHEAIYSLLMLRDGFMAGSAHIDDLDPRAEGFPILRQTQDATLNTVMSNSFGFGGTNAALVFGRT

SEQ ID NO: 15 - protein, 411 aa, Xanthomonas axonopodis pv. citri (strain 306)
MSRRVVVTGMGMVSPLGNDLATSWDGIVHGRSGIGPITQIDASQFTTKIAGEIKNFDPTLFVSAKDVKKMDSFIHYGVGASFMALDDSGLEIDESNAERVGAILGSGIGGLLGIEEQTIKFHEGGARKISPFYVPSTIINMLPGQVSLIKGLKGPTFSAVSACATSNHSIGTAMRMIQHGDADVMLAGGAERGSSPSSVGGFCAMKAMSTRNDDPAGASRPWDKQRDGFVLGDGAGVLVLEEYEHAKARGARIYAELVGFGASSDAFHMTAPSEDGEGAARSMAAAMRDAKLNPEQIGYLNAHGTSTPLGDLAETMAMKRALGDHAYKTMVSSTKSMTGHLLGAAGGVEAIFSVMALHTGIIPPTINLEEPSEGCDLDYVPNVARQVQVDAVMSNGFGFGGTNGTLVFKRV

SEQ ID NO: 16 - protein, 325 aa, Xanthomonas axonopodis pv. citri (strain 306)
MSKRIYSRIAGTGSYLPEKVLTNDDMSKIVDTSDEWIFSRTGIRERHIVADDQTTSDLAYFASLRAMEAAGVTADEIDLIVIGTTTPDLIFPSTACLLQARLGNIGCGAMDVNAACSGFVYALSVADKFVRSGDAKTVLVVGAETLTRIVDWTDRTTCVLFGDGAGAVILKADEETGILSTHLHADGSKKELLWDPVGVSVGFGEGKNGGGALLMKGNDVFKYAVKALDSVVDETLAASGYDKHDLDWLIPHQANLRIIEATAKRMELPMEQVVVTVDRHGNTSSASVPLALDEAVRSGRVQRGQLLLLEAFGGGFTWGSALLRY

SEQ ID NO: 17 - protein, 394 aa, Cupriavidus necator
  Cupriavidus necator (strain ATCC 17699 / H16 / DSM 428 / Stanier 337)
MTREVVVVSGVRTAIGTFGGSLKDVAPAELGALVVREALARAQVSGDDVGHVVFGNVIQTEPRDMYLGRVAAVNGGVTINAPALTVNRLCGSGLQAIVSAAQTILLGDTDVAIGGGAESMSRAPYLAPAARWGARMGDAGLVDMMLGALHDPFHRIHMGVTAENVAKEYDISRAQQDEAALESHRRASAAIKAGYFKDQIVPVVSKGRKGDVTFDTDEHVRHDATIDDMTKLRPVFVKENGTVTAGNASGLNDAAAAVVMMERAEAERRGLKPLARLVSYGHAGVDPKAMGIGPVPATKIALERAGLQVSDLDVIEANEAFAAQACAVTKALGLDPAKVNPNGSGISLGHPIGATGALITVKALHELNRVQGRYALVTMCIGGGQGIAAIFERI

SEQ ID NO: 18 - protein, 464 aa, Salmonella typhimurium
MNTSELETLIRTILSEQLTTPAQTPVQPQGKGIFQSVSEAIDAAHQAFLRYQQCPLKTRSAIISAMRQELTPLLAPLAEESANETGMGNKEDKFLKNKAALDNTPGVEDLTTTALTGDGGMVLFEYSPFGVIGSVAPSTNPTETIINNSISMLAAGNSIYFSPHPGAKKVSLKLISLIEEIAFRCCGIRNLVVTVAEPTFEATQQMMAHPRIAVLAITGGPGIVAMGMKSGKKVIGAGAGNPPCIVDETADLVKAAEDIINGASFDYNLPCIAEKSLIVVESVAERLVQQMQTFGALLLSPADTDKLRAVCLPEGQANKKLVGKSPSAMLEAAGIAVPAKAPRLLIALVNADDPWVTSEQLMPMLPVVKVSDFDSALALALKVEEGLHHTAIMHSQNVSRLNLAARTLQTSIFVKNGPSYAGIGVGGEGFTTFTIATPTGEGTTSARTFARSRRCVLTNGFSIR

SEQ ID NO: 19 - protein, 233 aa, Salmonella typhimurium (strain LT2 / SGSC1412 / ATCC 700720)
MAEKSCSLTEFVGTAIGDTLGLVIANVDTALLDAMKLEKRYRSIGILGARTGAGPHIMAADEAVKATNTEVVSIELPRDTKGGAGHGSLIILGGNDVSDVKRGIEVALKELDRTFGDVYGNEAGHIELQYTARASYALEKAFGAPIGRACGIIVGAPASVGVLMADTALKSANVEVVAYSSPAHGTSFSNEAILVISGDSGAVRQAVTSAREIGKTVLATLGSEPKNDRPSYI

SEQ ID NO: 20 - protein, 387 aa, Escherichia coli (strain K12)
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 21 - protein, 384 aa, Comamonas sp. (strain NCIMB 9872)
MNPFHFETTPRIICHNGASTKLGEAARNLGIRHAFFVTDKGVHQAGLTSAAMDSLKAADIAVTIFSEVQADPPESVIVQAAAAAREAGANGIIGFGGGSSMDTAKLVALLVKSPQELSAIYGAGLARGPRLPLIQIPTTAGTGSEVTPISVVTTPTDEKKPVVSSLLLPDIALLDAQLTIALPPAVTGATGVDALVHAIEALSTRLKRNPLSDLLAIKAVQMIYDHLPLAVKEGSNLEVREQMLLASLFAGMAFSNASVGAVHAFAYPLGVRFHVPHGLSNSLMLPHILRFNQQAAESTYALLGRSIRPELESASDAAASAAFVDAMSELVAQMPYAQSLRELGVERDDLAMLAKDVMGIQRLLDHNPCPITHEDAMKLYARAF

SEQ ID NO: 22 - protein, 360 aa, Saccharomyces cerevisiae (strain ATCC 204508 / S288c)
MSYPEKFEGIAIQSHEDWKNPKKTKYDPKPFYDHDIDIKIEACGVCGSDIHCAAGHWGNMKMPLVVGHEIVGKVVKLGPKSNSGLKVGQRVGVGAQVFSCLECDRCKNDNEPYCTKFVTTYSQPYEDGYVSQGGYANYVRVHEHFVVPIPENIPSHLAAPLLCGGLTVYSPLVRNGCGPGKKVGIVGLGGIGSMGTLISKAMGAETYVISRSSRKREDAMKMGADHYIATLEEGDWGEKYFDTFDLIVVCASSLTDIDFNIMPKAMKVGGRIVSISIPEQHEMLSLKPYGLKAVSISYSALGSIKELNQLLKLVSEKDIKIWVETLPVGEAGVHEAFERMEKGDVRYRFTLVGYDKEFSD

SEQ ID NO: 23 - protein, 382 aa, Cupriavidus necator (Alcaligenes eutrophus)
MAFIYYLTHIHLDFGAVSLLKSECERIGIRRPLLVTDKGVVAAGVAQRAIDAMQGLQVAVFDETPSNPTEAMVRKAAAQYREAGCDGLVAVGGGSSIDLAKGIAILATHEGELTTYATIEGGSARITDKAAPLIAVPTTSGTGSEVARGAIIILDDGRKLGFHSWHLLPKSAVCDPELTLGLPAGLTAATGMDAIAHCIETFLAPAFNPPADGIALDGLERGWGHIERATRDGQDRDARLNMMSASMQGAMAFQKGLGCVHSLSHPLGGLKIDGRTGLHHGTLNAVVMPAVLRFNADAPTVVRDDRYARLRRAMHLPDGADIAQAVHDMTVRLGLPTGLRQMGVTEDMFDKVIAGALVDHCHKTNPKEASAADYRRMLEQSM

SEQ ID NO: 24 - protein, 496 aa, Kibdelosporangium sp. MJ126-NF4
MADLTTWLAAAAAFRPETRLFVDGDHIDAASGETFSDISPRDGKPVAEVAAGGTEDVDRAVRAARRAFDSGVWRDRPPRERKRVLTRFAELIRDNAETLALAETLDVGKPIAESVRVDVEGAANCLQWYAEAIDKTYGEIAPTGPDALATITREPLGVIGAVVPWNYPMIIASWKIAPALATGNSVVLKPAEQSPLSALLLARLGAEAGLPPGVFNVVTGFGQTAGQALGRHPDVDKIAFTGSPEVGRLLLRYAGESNGKAVSVESGGKSPQLVLADVADVQAAASAVAWGIFYNAGQTCNAGSRLVVDEAVKDELLDEVLKVAATFQVGDPLDPATTMGAIVDARQLARVLDYVDIGRAEGATVALGGTQTRADSGGYFVEPTVLDHVRNDSRVAQEEIFGPVLTTTTFRGVDEGVRIANDTRYGLAAAVWTRDVTTAHVVARRLRAGMVWVNTFDASDVITPFGGFKDSGSGRDKSLHALDGYTGLKTTWITLR

SEQ ID NO: 25 - protein, 1174 aa, Mycobacterium marinum (strain ATCC BAA-535 / M)
MSPITREERLERRIQDLYANDPQFAAAKPATAITAAIERPGLPLPQIIETVMTGYADRPALAQRSVEFVTDAGTGHTTLRLLPHFETISYGELWDRISALADVLSTEQTVKPGDRVCLLGFNSVDYATIDMTLARLGAVAVPLQTSAAITQLQPIVAETQPTMIAASVDALADATELALSGQTATRVLVFDHHRQVDAHRAAVESARERLAGSAVVETLAEAIARGDVPRGASAGSAPGTDVSDDSLALLIYTSGSTGAPKGAMYPRRNVATFWRKRTWFEGGYEPSITLNFMPMSHVMGRQILYGTLCNGGTAYFVAKSDLSTLFEDLALVRPTELTFVPRVWDMVFDEFQSEVDRRLVDGADRVALEAQVKAEIRNDVLGGRYTSALTGSAPISDEMKAWVEELLDMHLVEGYGSTEAGMILIDGAIRRPAVLDYKLVDVPDLGYFLTDRPHPRGELLVKTDSLFPGYYQRAEVTADVFDADGFYRTGDIMAEVGPEQFVYLDRRNNVLKLSQGEFVTVSKLEAVFGDSPLVRQIYIYGNSARAYLLAVIVPTQEALDAVPVEELKARLGDSLQEVAKAAGLQSYEIPRDFIIETTPWTLENGLLTGIRKLARPQLKKHYGELLEQIYTDLAHGQADELRSLRQSGADAPVLVTVCRAAAALLGGSASDVQPDAHFTDLGGDSLSALSFTNLLHEIFDIEVPVGVIVSPANDLQALADYVEAARKPGSSRPTFASVHGASNGQVTEVHAGDLSLDKFIDAATLAEAPRLPAANTQVRTVLLTGATGFLGRYLALEWLERMDLVDGKLICLVRAKSDTEARARLDKTFDSGDPELLAHYRALAGDHLEVLAGDKGEADLGLDRQTWQRLADTVDLIVDPAALVNHVLPYSQLFGPNALGTAELLRLALTSKIKPYSYTSTIGVADQIPPSAFTEDADIRVISATRAVDDSYANGYSNSKWAGEVLLREAHDLCGLPVAVFRCDMILADTTWAGQLNVPDMFTRMILSLAATGIAPGSFYELAADGARQRAHYDGLPVEFIAEAISTLGAQSQDGFHTYHVMNPYDDGIGLDEFVDWLNESGCPIQRIADYGDWLQRFETALRALPDRQRHSSLLPLLHNYRQPERPVRGSIAPTDRFRAAVQEAKIGPDKDIPHVGAPIIVKYVSDLRLLGLL

SEQ ID NO: 26 - protein, 1174 aa, Nocardia iowensis
MAVDSPDERLQRRIAQLFAEDEQVKAARPLEAVSAAVSAPGMRLAQIAATVMAGYADRPAAGQRAFELNTDDATGRTSLRLLPRFETITYRELWQRVGEVAAAWHHDPENPLRAGDFVALLGFTSIDYATLDLADIHLGAVTVPLQASAAVSQLIAILTETSPRLLASTPEHLDAAVECLLAGTTPERLVVFDYHPEDDDQRAAFESARRRLADAGSLVIVETLDAVRARGRDLPAAPLFVPDTDDDPLALLIYTSGSTGTPKGAMYTNRLAATMWQGNSMLQGNSQRVGINLNYMPMSHIAGRISLFGVLARGGTAYFAAKSDMSTLFEDIGLVRPTEIFFVPRVCDMVFQRYQSELDRRSVAGADLDTLDREVKADLRQNYLGGRFLVAVVGSAPLAAEMKTFMESVLDLPLHDGYGSTEAGASVLLDNQIQRPPVLDYKLVDVPELGYFRTDRPHPRGELLLKAETTIPGYYKRPEVTAEIFDEDGFYKTGDIVAELEHDRLVYVDRRNNVLKLSQGEFVTVAHLEAVFASSPLIRQIFIYGSSERSYLLAVIVPTDDALRGRDTATLKSALAESIQRIAKDANLQPYEIPRDFLIETEPFTIANGLLSGIAKLLRPNLKERYGAQLEQMYTDLATGQADELLALRREAADLPVLETVSRAAKAMLGVASADMRPDAHFTDLGGDSLSALSFSNLLHEIFGVEVPVGVVVSPANELRDLANYIEAERNSGAKRPTFTSVHGGGSEIRAADLTLDKFIDARTLAAADSIPHAPVPAQTVLLTGANGYLGRFLCLEWLERLDKTGGTLICVVRGSDAAAARKRLDSAFDSGDPGLLEHYQQLAARTLEVLAGDIGDPNLGLDDATWQRLAETVDLIVHPAALVNHVLPYTQLFGPNVVGTAEIVRLAITARRKPVTYLSTVGVADQVDPAEYQEDSDVREMSAVRVVRESYANGYGNSKWAGEVLLREAHDLCGLPVAVFRSDMILAHSRYAGQLNVQDVFTRLILSLVATGIAPYSFYRTDADGNRQRAHYDGLPADFTAAAITALGIQATEGFRTYDVLNPYDDGISLDEFVDWLVESGHPIQRITDYSDWFHRFETAIRALPEKQRQASVLPLLDAYRNPCPAVRGAILPAKEFQAAVQTAKIGPEQDIPHLSAPLIDKYVSDLELLQLL

SEQ ID NO: 27 - protein, 1168 aa, Mycobacterium smegmatis (strain ATCC 700084 / mc(2)155)
MTIETREDRFNRRIDHLFETDPQFAAARPDEAISAAAADPELRLPAAVKQILAGYADRPALGKRAVEFVTDEEGRTTAKLLPRFDTITYRQLAGRIQAVTNAWHNHPVNAGDRVAILGFTSVDYTTIDIALLELGAVSVPLQTSAPVAQLQPIVAETEPKVIASSVDFLADAVALVESGPAPSRLVVFDYSHEVDDQREAFEAAKGKLAGTGVVVETITDALDRGRSLADAPLYVPDEADPLTLLIYTSGSTGTPKGAMYPESKTATMWQAGSKARWDETLGVMPSITLNFMPMSHVMGRGILCSTLASGGTAYFAARSDLSTFLEDLALVRPTQLNFVPRIWDMLFQEYQSRLDNRRAEGSEDRAEAAVLEEVRTQLLGGRFVSALTGSAPISAEMKSWVEDLLDMHLLEGYGSTEAGAVFIDGQIQRPPVIDYKLVDVPDLGYFATDRPYPRGELLVKSEQMFPGYYKRPEITAEMFDEDGYYRTGDIVAELGPDHLEYLDRRNNVLKLSQGEFVTVSKLEAVFGDSPLVRQIYVYGNSARSYLLAVVVPTEEALSRWDGDELKSRISDSLQDAARAAGLQSYEIPRDFLVETTPFTLENGLLTGIRKLARPKLKAHYGERLEQLYTDLAEGQANELRELRRNGADRPVVETVSRAAVALLGASVTDLRSDAHFTDLGGDSLSALSFSNLLHEIFDVDVPVGVIVSPATDLAGVAAYIEGELRGSKRPTYASVHGRDATEVRARDLALGKFIDAKTLSAAPGLPRSGTEIRTVLLTGATGFLGRYLALEWLERMDLVDGKVICLVRARSDDEARARLDATFDTGDATLLEHYRALAADHLEVIAGDKGEADLGLDHDTWQRLADTVDLIVDPAALVNHVLPYSQMFGPNALGTAELIRIALTTTIKPYVYVSTIGVGQGISPEAFVEDADIREISATRRVDDSYANGYGNSKWAGEVLLREAHDWCGLPVSVFRCDMILADTTYSGQLNLPDMFTRLMLSLVATGIAPGSFYELDADGNRQRAHYDGLPVEFIAEAISTIGSQVTDGFETFHVMNPYDDGIGLDEYVDWLIEAGYPVHRVDDYATWLSRFETALRALPERQRQASLLPLLHNYQQPSPPVCGAMAPTDRFRAAVQDAKIGPDKDIPHVTADVIVKYISNLQMLGLL

SEQ ID NO: 28 - protein, 1173 aa, Mycobacterium smegmatis
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMLARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLQAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 29 - protein, 1173 aa, Mycobacterium smegmatis (strain ATCC 700084 / mc(2)155)
MTSDVHDATDGVTETALDDEQSTRRIAELYATDPEFAAAAPLPAVVDAAHKPGLRLAEILQTLFTGYGDRPALGYRARELATDEGGRTVTRLLPRFDTLTYAQVWSRVQAVAAALRHNFAQPIYPGDAVATIGFASPDYLTLDLVCAYLGLVSVPLQHNAPVSRLAPILAEVEPRILTVSAEYLDLAVESVRDVNSVSQLVVFDHHPEVDDHRDALARAREQLAGKGIAVTTLDAIADEGAGLPAEPIYTADHDQRLAMILYTSGSTGAPKGAMYTEAMVARLWTMSFITGDPTPVINVNFMPLNHLGGRIPISTAVQNGGTSYFVPESDMSTLFEDLALVRPTELGLVPRVADMLYQHHLATVDRLVTQGADELTAEKQAGAELREQVLGGRVITGFVSTAPLAAEMRAFLDITLGAHIVDGYGLTETGAVTRDGVIVRPPVIDYKLIDVPELGYFSTDKPYPRGELLVRSQTLTPGYYKRPEVTASVFDRDGYYHTGDVMAETAPDHLVYVDRRNNVLKLAQGEFVAVANLEAVFSGAALVRQIFVYGNSERSFLLAVVVPTPEALEQYDPAALKAALADSLQRTARDAELQSYEVPADFIVETEPFSAANGLLSGVGKLLRPNLKDRYGQRLEQMYADIAATQANQLRELRRAAATQPVIDTLTQAAATILGTGSEVASDAHFTDLGGDSLSALTLSNLLSDFFGFEVPVGTIVNPATNLAQLAQHIEAQRTAGDRRPSFTTVHGADATEIRASELTLDKFIDAETLRAAPGLPKVTTEPRTVLLSGANGWLGRFLTLQWLERLAPVGGTLITIVRGRDDAAARARLTQAYDTDPELSRRFAELADRHLRVVAGDIGDPNLGLTPEIWHRLAAEVDLVVHPAALVNHVLPYRQLFGPNVVGTAEVIKLALTERIKPVTYLSTVSVAMGIPDFEEDGDIRTVSPVRPLDGGYANGYGNSKWAGEVLLREAHDLCGLPVATFRSDMILAHPRYRGQVNVPDMFTRLLLSLLITGVAPRSFYIGDGERPRAHYPGLTVDFVAEAVTTLGAQQREGYVSYDVMNPHDDGISLDVFVDWLIRAGHPIDRVDDYDDWVRRFETALTALPEKRRAQTVLPLLHAFRAPQAPLRGAPEPTEVFHAAVRTAKVGPGDIPHLDEALIDKYIRDLREFGLI

SEQ ID NO: 30 - protein, 1173 aa, Mycobacterium avium
MSTATHDERLDRRVHELIATDPQFAAAQPDPAITAALEQPGLRLPQIIRTVLDGYADRPALGQRVVEFVTDAKTGRTSAQLLPRFETITYSEVAQRVSALGRALSDDAVHPGDRVCVLGFNSVDYATIDMALGAIGAVSVPLQTSAAISSLQPIVAETEPTLIASSVNQLSDAVQLITGAEQAPTRLVVFDYHPQVDDQREAVQDAAARLSSTGVAVQTLAELLERGKDLPAVAEPPADEDSLALLIYTSGSTGAPKGAMYPQSNVGKMWRRGSKNWFGESAASITLNFMPMSHVMGRSILYGTLGNGGTAYFAARSDLSTLLEDLELVRPTELNFVPRIWETLYGEFQRQVERRLSEAGDAGERRAVEAEVLAEQRQYLLGGRFTFAMTGSAPISPELRNWVESLLEMHLMDGYGSTEAGMVLFDGEIQRPPVIDYKLVDVPDLGYFSTDRPHPRGELLLRTENMFPGYYKRAETTAGVFDEDGYYRTGDVFAEIAPDRLGYVDRRNNVLKLAQGEFVTLAKLEAVFGNSPLIRQIYVYGNSAQPYLLAVVVPTEEALASGDPETLKPKIADSLQQVAKEAGLQSYEVPRDFIIETTPFSLENGLLTGIRKLAWPKLKQHYGERLEQMYADLAAGQANELAELRRNGAQAPVLQTVSRAAGAMLGSAASDLSPDAHFTDLGGDSLSALTFGNLLREIFDVDVPVGVIVSPANDLAAIASYIEAERQGSKRPTFASVHGRDATVVRAADLTLDKFLDAETLAAAPNLPKPATEVRTVLLTGATGFLGRYLALEWLERMDMVDGKVIALVRARSDEEARARLDKTFDSGDPKLLAHYQQLAADHLEVIAGDKGEANLGLGQDVWQRLADTVDVIVDPAALVNHVLPYSELFGPNALGTAELIRLALTSKQKPYTYVSTIGVGDQIEPGKFVENADIRQMSATRAINDSYANGYGNSKWAGEVLLREAHDLCGLPVAVFRCDMILADTTYAGQLNLPDMFTRLMLSLVATGIAPGSFYELDADGNRQRAHYDGLPVEFIAAAISTLGSQITDSDTGFQTYHVMNPYDDGVGLDEYVDWLVDAGYSIERIADYSEWLRRFETSLRALPDRQRQYSLLPLLHNYRTPEKPINGSIAPTDVFRAAVQEAKIGPDKDIPHVSPPVIVKYITDLQLLGLL

SEQ ID NO: 31 - protein, 1148 aa, Segniliparus rugosus ATCC BAA-974
MGDGEERAKRFFQRIGELSATDPQFAAAAPDPAVVEAVSDPSLSFTRYLDTLMRGYAERPALAHRVGAGYETISYGELWARVGAIAAAWQADGLAPGDFVATVGFTSPDYVAVDLAAARSGLVSVPLQAGASLAQLVGILEETEPKVLAASASSLEGAVACALAAPSVQRLVVFDLRGPDASESAADERRGALADAEEQLARAGRAVVVETLADLAARGEALPEAPLFEPAEGEDPLALLIYTSGSTGAPKGAMYSQRLVSQLWGRTPVVPGMPNISLHYMPLSHSYGRAVLAGALSAGGTAHFTANSDLSTLFEDIALARPTFLALVPRVCEMLFQESQRGQDVAELRERVLGGRLLVAVCGSAPLSPEMRAFMEEVLGFPLLDGYGSTEALGVMRNGIIQRPPVIDYKLVDVPELGYRTTDKPYPRGELCIRSTSLISGYYKRPEITAEVFDAQGYYKTGDVMAEIAPDHLVYVDRSKNVLKLSQGEFVAVAKLEAAYGTSPYVKQIFVYGNSERSFLLAVVVPNAEVLGARDQEEAKPLIAASLQKIAKEAGLQSYEVPRDFLIETEPFTTQNGLLSEVGKLLRPKLKARYGEALEARYDEIAHGQADELRALRDGAGQRPVVETVVRAAVAISGSEGAEVGPEANFADLGGDSLSALSLANLLHDVFEVEVPVRIIIGPTASLAGIAKHIEAERAGASAPTAASVHGAGATRIRASELTLEKFLPEDLLAAAKGLPAADQVRTVLLTGANGWLGRFLALEQLERLARSGQDGGKLICLVRGKDAAAARRRIEETLGTDPALAARFAELAEGRLEVVPGDVGEPKFGLDDAAWDRLAEEVDVIVHPAALVNHVLPYHQLFGPNVVGTAEIIRLAITAKRKPVTYLSTVAVAAGVEPSSFEEDGDIRAVVPERPLGDGYANGYGNSKWAGEVLLREAHELVGLPVAVFRSDMILAHTRYTGQLNVPDQFTRLVLSLLATGIAPKSFYQQGAAGERQRAHYDGIPVDFTAEAITTLGAEPSWFDGGAGFRSFDVFNPHHDGVGLDEFVDWLIEAGHPISRIDDHKEWFARFETAVRGLPEAQRQHSLLPLLRAYSFPHPPVDGSVYPTGKFQGAVKAAQVGSDHDVPHLGKALIVKYADDLKALGLL

SEQ ID NO: 32 - protein, 1168 aa, Mycobacterium sp. JS623
MSTVSREERLARRISDLYATDQQFADARPSEAVAHAIESPALRLPQIIQTVIDGYAERPALGQRAVEFVTDPTTGRTSAALLPRFDTITYRELSERVDAVATALTQNPVRPGDRVAILGFTSIDYTTVDMALLRAGAVSVPLQTSAPVAQLRPIAAETEPVAILSSVDFLDDAVELMLTGHLPERLVVFDYHAEVDDHREALASATARLAETPVVVETLAEVLARGNALPAHPAFDAGDDNLALLIYTSGSTGTPKGAMYLAKAVANSWRRSSMAMWGNEGATPSITLNFMPMSHMMGRGILYATLGAGGTAYFVARSDLSTFFDDLSLVRPTQLSFVPRIWDMVFAEYQSEVDRRSADGGDRWAVEADVLADLRQNLLGGRFISAMTGSAPISSEMRTFVESLLDIHLTDGYGSTEAGAVFVDGQVQRPPVIDYKLVDVPDLGYFSTDRPYPRGELLVKSETMFPGYYKRPEITADVFDADGYYRTGDVVAELGPDQLQYLDRRNNVLKLSQGEFVTVAKLEAVFVDSPLIRQIFVYGNSARSYLLAVIVPTEEALARHDAAELKQLITESLQDVAKATGLQSYEIPRDFIIETTPFTLENGLLTGIRKLARPKLKEFYGERLEQLYTDLADSQANELRELRQHGADRPVLETISRAAGALLGAAASELQPDAHFTDLGGDSLSALTFANLLHEIFEIDVPVGVIVSPANDLAALAAYIEAERQPGSKRPTFASVHGRDATEVYANDLTLDKFIDAKTLAAASSLPGPSSEVRTVLLTGATGFLGRYLALEWLERMDMVDGKVIALVRAKDDDAARERLDKTFDSGDPELLRHYHELAADHLEVIAGDKGEANLGLDQQTWQRLADTVDLIVDPAALVNHVLPYSQLFGPNALGTAELIRIALTTKQKPFVYVSTIGVGAGIEPGQFTEDGDVRVYSATRKVDDTYANGYGNSKWAGEVLLREAHDLGLPVSVFRCDMILADTTYAGQLNLPDMFTRLMLSLVATGIAPDSFYEVDANGNRQRAHYDGLPVEFIAEAISTLGAQVVDGFETYHVMNPYDDGIGLDEYVDWLIEAGFPVERVGDYTTWLQRFDTAVRALPERQRQASLLPLLHNYQRPETPIRGSIAPTDRFRAAVQDAKIGPDKDIPHVTRDVIVKYITDLQLLGLL

SEQ ID NO: 33 - protein, 1170 aa, Mycobacterium heckeshornense
MSIDTREEQLERRIAELAANDPQFAAARPDPAVAAALEQPGLRLPQVIQTVLEGYADRPALGQRAVEVVKDPTTGRTSARLLPRFDTITYRELTDRVDALASAWAHEAVSPGDRVAILGFTSVDYTTIDVTLARIGAVSVPLQTSAAVDRLRPIVAETEPRVIAASVAYLSDAVELILTGHAPARLVVFDYHREVDDHREALDAARGRLAGHSVPVETLAEVLERGRALPAPTVAAEDDDLALLIYTSGSTGTPKGAMYPQRNVAKMWQRSSRNWFGPSAASITLNFMPMSHVMGRGILYGTLGNGGTAYFGATSDLSTLLEDLALVRPTELNFVPRVWDTLHAEFLARVDRLTAEGADRATAETQVMDDLRDHLLGGRAIFAMTGSAPISAELKAWVESLVGIHLLDGYGSTEAGMVLYDGVVQRPPVIDYKLADVPDLGYFSTDRPFPRGELLLKTENMFPGYYQRPEITADVFDDDGYYRTGDVVAEVGPDRLVYVDRRNNVLKLAQGEFVTVAKLEAVLGNSPLVRQIYVYGNSAHPYLLAVVVPTEDALARPDRDELKRRIAESLQRVAKDAGLQSYEVPRDFLIETEPFTVENGLLTGIRKLAWPKLKERYGERLERLYAELDRNQADELSELRRGGAERPVLETVTRAAGALLGAAVSELQPDVRFTDLGGDSLSAVTFGSLLREIYDVDVPVGVIVSPASDLQAIAGFIAAALAPDGSKRPTFASVHAGPDEGAAVEVHARDLTLDKFLDAHTLATAPTLPGPGTEVRTVLLTGATGFLGRYLALEWLERMNLVDGTVIALVRAKDDASARERLDRTFAGDPKLRAHYRELAADHLEVVAGDKSEANLGLDQPTWQRLADTVDVIVDPAALVNHVLPYRELFGPNVLGTAELIRLALTTKIKPYTYVSTIGVGDQIEPARFTEDADIRVISPTRRISDAYANGYGNSKWAGEVLLREAHDLCGLPVTVFRCDMILADTTYAGQLNLPDMFTRLMLSLVATGIAPRSFYELDAEGNRQRAHYDGLPVEFIAAAISTLGTPAPAGYQTYHVMNPHDDGIGLDEYVDWLIESGYPIQRVDDYADWLRRFETAMRALPDRQRQYSLLPLLHNYQKPEKPIRGSMAPTDRFRAAVHEKKIGPDHDIPHVTREIIVKYATDLQLLGFL

SEQ ID NO: 34 - protein, 1172 aa, Mycobacterium goodii
MPTNPRQERLARRIAQLYATDAQFAGARPDDAVTEAIERPDMRLHQVVGAVMEAYADRPAIAERAVEIVEDPVTGRTSAELLPRFDTITYRELSDRVAALARALCDDVRPGDRVCVLGFASADYAVIDMATMHLGAVAVPLQTSAPVGQLQPIVAETEPRLFASSIGDLDTAVELVLAGHTPARLVVFDHHPAVDEERETLQRARQRLGDAGVQVVVEPLADLIERGRSAPDVAYHVADEDDPLRLLIYTSGSTGAPKGAMYPERLVANFWRRSRWNWSGTAAQPSITLNFMPMSHVMGRGILYGTLGHGGTAYFTARSDLSTLYEDLALVRPTELNFVPRVWDMLFGTFQSEVRRRAAEEGMHENLEADVMADLAQHLLGGRYILAMTGSAPISAENKAFVEQLLDLHLIEGYGSTEAGMVFVDGTVRRPAVIDYKLADVPDLGYFRTDQPHARGELLVKTRDLFPGYYKRPEVTADVFDPDGFYRTGDVVAEIGPDQLVYLDRRNNVLKLSQGEFVTVSKLEPLFGDSPLVRQIYIYGNSARAYLLAVVVPTEDALRQSGGSLDALKNAITASFQDIARSSGLQSYEIPRDFLIETTPFTLENGLLTGIRKLARPKLKAHYAERLEALYTELADNQANELAALRRDGANRPVLETVGRAAGALLGAAADALAPDAHFTDLGGDSLSALTFGNLLHEIFGVEVSVGVIVSPASDLRAIADYVESQRSPGLARPSFASVHGRDATEVRAADLTLEKFIDAETLSAPRSAPSAQVRTVLLTGATGFLGRYLALEWLERMSRVGGTVICLVRAKDDASARRRLDRTFDSGDPELLHRYLDLADRHLRVMAGDKGEADLGLDPLTWQRLADTVDVIVDPAALVNHVLPYRELFGPNVVGTAELIRLALTTKLKPYTYVSTIGVGDQIEPSLFTEDADIRTVSAVRAIDDSYANGYGNSKWAGEVLLREAHDRCGLPVAVFRCDMILADTRYAGQLNVPDMFTRLMLSLVATGIAPGSFYELDAHGNRQRAHYDGLPVGFIAEAIATLGAGADGFSTYHVMNPHDDGIGLDEFVDWLDEAGYPIERIPDYAAWLQRFDTALHALPDAQRQASLLPLLHNYQHPGKPIRGSQAPTDRFRAAVRQAKIGADGGNPDIPQVSAPIIVKYVTDLQKLGLL

SEQ ID NO: 35 - protein, 1172 aa, Mycobacterium goodii
MTSDVHDASRDGTDQDEQSARRIAELYATDREFAAATPLPEVYDAAHKPGLRLAEIVQTLYTGYGDRPALGYRARELTVDPDTGRTVARLLPRFDTVSYSQVWSRVQAVATALRHNFTQPIYPGDAIATIGFASPDYLTLDLVCAYLGLVTVPLQHNAPVSRLAPILAEVEPRILAVSAEYLDLAIESIKDVTSVTQLVVFDHLPGVDDHRDGLARARRQLEGTAIAVTTLDEIAEQGAQLAVEPIYTADTDQRLAMILYTSGSTGAPKGAMYTEAMVSKLWSMSFITGDPIPVINVNFMPLNHLGGRIPISTAAQNGGTSYFVPESDMSTLLDDLALVRPTELALVPRVADMLHQQYLATVDRLVAEGSDEATADKQARDELRDQVLGGRVVNGFVSTAPLAAEMKTFLDVTLGAHIVDGYGLTETGPVTRDGVVVRPPVVDYKLIDVPELGYFGTDKPYPRGELIVRSEALTPGYYKRPEVTAGVFDADGYYHTGDVMAEIAPDHLVYVDRRNNVLKLAQGEFVAVANLESIYSSAPLIRQIFVYGNSERSSLLAVVVPTPDALEQYDRTGLKTALADSLQRTAREAELQSYEVPADFIIETEPFSAANGLLSGVGKLLRPNLKQHYGQRLEQMYADIAAAQADQLRDLRRAAATQPVIDTLTQAAATILGAGQEVSPQAHFTDLGGDSLSALTLSNLLGDFFGFEVPVGTIVNPATNLAQLAENIEAQRAAGNRRPTFASVHAADATEIRATELTLDKFIDAETLSAAPNLPKATAEPRTVLLTGANGWLGRFVALEWLQRLAPVGGTLIAIVRGSDDAAARARLAESYDTDPELSRRFAELAEHLQVFAGDIAEPNLGLAPDLWRRLAAEVDLVAHPGALVNHVLPYRQLFGPNVVGTAEVIKLAITERIKPVTYLSTVSVAVGIPNFEEDGDIRTVSPVRPLDGGYANGYGNSKWAGEVLLREAHDLCGLPVATLRSDMILAHPRYSGQLNVPDMFTRLLLSLLITGVAPRSFYLADGRGERPRAHYDALPVDFVAESVVTLGAQQREGYVSYDVMNPHDDGISLDVLVDWLIQNGNPIERVDEHADWVRRFETALTALPEKRRAQTVLPLMDAFRAPQVPLRGAPEPTEVFHDAVRAAKVGQGDIPHLDAALLDKYVRDLRGLGLI

SEQ ID NO: 36 - protein, 1188 aa, Mycobacterium intracellulare
  Mycobacterium intracellulare (strain ATCC 13950 / DSM 43223 / JCM 6384 / NCTC 13025 / 3600)
MTDTVTDSGREQRLTERVEQLYANDPQFRAAAPSPEVTEAAHRAGLRLAEVVDIYLSGYADRPALGQRACEVARDPATGRAATSLLPGFETITYRELGDRVAALAAAWRSGLPGGLRPGDFVGVLGFTSIDYVVHYLACIRLGTVFVPLQTSSTAAQLAPIVAETSPRILAVSVESLGTAVDVVLEAPSVQRLVVFDYTSDDDEQRGRYDDARARLRDAGHGAEMVALAAELATGRGCPAPEAYVPGRSENPLATLIYTSGSTGTPKGAMYTADMMTRIWQRPHSPSVDIGRVVPAIHLQYMPLSHVYGLEWLIATLSSGGIGYFAAKSDMSTLFDDIGLVRPTALNLVPRVCDMFFRRYRKELDQRAGDGLTAEQRDEAVKAELRQDFIGGRVVSAMCGSAPLSKQMHAFMESLLDVTVADGYGATETGGGIIRSGRIRRPPVTDYKLVDVPELGYLTTDKPYPRGELHLKASNVIPGYFKHPELSAQIFDDEGFYKTGDIMAELGPDHLMYLDRSNNVIKLSQGEFVAVSQLEATFSTSPYIRQIFLYGSSEQPFLLAVIVPNVDAVGGGDARALIAESLQQIAADSHLHPYEVPRDFLLEPQRFTRDNGLLSGVGKLLRPALKARYGERLDAMYDEIEASHGNQLDELRSASRELPTIDTVRRAAAATLGLPADAALRGDAKFIELGGDSLSAFSFATLLSEIFHIDVPVQTIVSPTATLATIANYVDGERTSESTRPTFASVHGRGATVARAADLTLAKFIDDDTLAAAPHLPAPTGAVNTVLLTGANGYLGRFLCLDWLERLAPTGGTVICLARGADPTAGRQRIEAAIDSGDAELSRRFRQLADKHLQVLVGDVGAANLGLDTPTYQRLARSVDLVVHSAALVNHVLPYSQLFGPNVVGTAEIVKLAISERLKPINYISTVAVTTLPYGSFIGEDADVRSASPSRSLDESYASGYATSKWAGEVLLREAHDLCGVPVAVFRSDMILAHSDFAGQLNVPDMFTRLILSLVATGIAPRSFYQLDASGNRQRAHYDGLPADFTAEAITTLGARTRQGYHTYNVLNTHDDGVSLDTFVDWLIADGHEIERVDDYDEWLARFTAAMKSLPDNQRKSSLLPLMSAYAKPGQPTHGTGMPAEKFRAAVQSAGIGATRDVPHVTQALIDKYVADLQRLGLLRTRAGAHAG

SEQ ID NO: 37 - protein, 1185 aa, Mycobacterium abscessus subsp. bolletii 2B-0307
MTNETNPQQEQLSRRIESLRESDPQFRAAQPDPAVAEQVLRPGLHLSEAIAALMTGYAERPALGERARELVIDQDGRTTLRLLPRFDTTTYGELWSRTTSVAAAWHHDATHPVKAGDLVATLGFTSIDYTVLDLAIMILGGVAVPLQTSAPASQWTTILAEAEPNTLAVSIELIGAAMESVRATPSIKQVVVFDYTPEVDDQREAFEAASTQLAGTGIALETLDAVIARGAALPAAPLYAPSAGDDPLALLIYTSGSTGAPKGAMHSENIVRRWWIREDVMAGTENLPMIGLNFMPMSHIMGRGTLTSTLSTGGTGYFAASSDMSTLFEDMELIRPTALALVPRVCDMVFQRFQTEVDRRLASGDTASAEAVAAEVKADIRDNLFGGRVSAVMVGSAPLSEELGEFIESCFELNLTDGYGSTEAGMVFRDGIVQRPPVIDYKLVDVPELGYFSTDKPHPRGELLLKTDGMFLGYYKRPEVTASVFDADGFYMTGDIVAELAHDNIEIIDRRNNVLKLSQGEFVAVATLEAEYANSPVVHQIYVYGSSERSYLLAVVVPTPEAVAAAKGDAAALKTTIADSLQDIAKEIQLQSYEVPRDFIIEPQPFTQGNGLLTGIAKLARPNLKAHYGPRLEQMYAEIAEQQAAELRALHGVDPDKPALETVLKAAQALLGVSSAELAADAHFTDLGGDSLSALSFSDLLRDIFAVEVPVGVIVSAANDLGGVAKFVDEQRHSGGTRPTAETVHGAGHTEIRAADLTLDKFIDEATLHAAPSLPKAAGIPHTVLLTGSNGYLGHYLALEWLERLDKTDGKLIVIVRGKNAEAAYGRLEEAFDTGDTELLAHFRSLADKHLEVLAGDIGDPNLGLDADTWQRLADTVDVIVHPAALVNHVLPYNQLFGPNVVGTAEIIKLAITTKIKPVTYLSTVAVAAYVDPTTFDEESDIRLISAVRPIDDGYANGYGNAKWAGEVLLREAHDLCGLPVAVFRSDMILAHSRYTGQLNVPDQFTRLILSLIATGIAPGSFYQAQTTGERPLAHYDGLPGDFTAEAITTLGTQVPEGSEGFVTYDCVNPHADGISLDNFVDWLIEAGYPIARIDNYTEWFTRFDTAIRGLSEKQKQHSLLPLLHAFEQPSAAENHGVVPAKRFQHAVQAAGIGPVGQDGTTDIPHLSRRLIVKYAKDLEQLGLL

SEQ ID NO: 38 - protein, 1186 aa, Segniliparus rotundus
  Segniliparus rotundus (strain ATCC BAA-972 / CDC 1076 / CIP 108378 / DSM 44985 / JCM 13578)
MTQSHTQGPQASAAHSRLARRAAELLATDPQAAATLPDPEVVRQATRPGLRLAERVDAILSGYADRPALGQRSFQTVKDPITGRSSVELLPTFDTITYRELRERATAIASDLAHHPQAPAKPGDFLASIGFISVDYVAIDIAGVFAGLTAVPLQTGATLATLTAITAETAPTLFAASIEHLPTAVDAVLATPSVRRLLVFDYRAGSDEDREAVEAAKRKIADAGSSVLVDVLDEVIARGKSAPKAPLPPATDAGDDSLSLLIYTSGSTGTPKGAMYPERNVAHFWGGVWAAAFDEDAAPPVPAINITFLPLSHVASRLSLMPTLARGGLMHFVAKSDLSTLFEDLKLARPTNLFLVPRVVEMLYQHYQSELDRRGVQDGTREAEAVKDDLRTGLLGGRILTAGFGSAPLSAELAGFIESLLQIHLVDGYGSTEAGPVWRDGYLVKPPVTDYKLIDVPELGYFSTDSPHPRGELAIKTQTILPGYYKRPETTAEVFDEDGFYLTGDVVAQIGPEQFAYVDRRKNVLKLSQGEFVTLAKLEAAYSSSPLVRQLFVYGSSERSYLLAVIVPTPDALKKFGVGEAAKAALGESLQKIARDEGLQSYEVPRDFIIETDPFTVENGLLSDARKSLRPKLKEHYGERLEAMYKELADGQANELRDIRRGVQQRPTLETVRRAAAAMLGASAAEIKPDAHFTDLGGDSLSALTFSNFLHDLFEVDVPVGVIVSAANTLGSVAEHIDAQLAGGRARPTFATVHGKGSTTIKASDLTLDKFIDEQTLEAAKHLPKPADPPRTVLLTGANGWLGRFLALEWLERLAPAGGKLITIVRGKDAAQAKARLDAAYESGDPKLAGHYQDLAATTLEVLAGDFSEPRLGLDEATWNRLADEVDFISHPGALVNHVLPYNQLFGPNVAGVAEIIKLAITTRIKPVTYLSTVAVAAGVEPSALDEDGDIRTVSAERSVDEGYANGYGNSKWGGEVLLREAHDRTGLPVRVFRSDMILAHQKYTGQVNATDQFTRLVQSLLATGLAPKSFYELDAQGNRQRAHYDGIPVDFTAESITTLGGDGLEGYRSYNVFNPHRDGVGLDEFVDWLIEAGHPITRIDDYDQWLSRFETSLRGLPESKRQASVLPLLHAFARPGPAVDGSPFRNTVFRTDVQKAKIGAEHDIPHLGKALVLKYADDIKQLGLL

SEQ ID NO: 39 - protein, 1148 aa, Segniliparus rotundus
  Segniliparus rotundus (strain ATCC BAA-972 / CDC 1076 / CIP 108378 / DSM 44985 / JCM 13578)
MGSGADRAKLFFQKIEELTAADPQFAAAVPDQEVVAAVSDPTLSFTRYLDTLMRGYADRPALAHRVGDGYATISYGELWSRVGAIAAAWSADGLEPGDFVATIGFTSPDYTALDLAATRSGLVSVPLQAGASVAQLSAILEETAPKVFAASAESLEGAVDCVLRTPSVQRLVIFDLRDDSPEHRAALAAAKAKLAQPQNPEQARGPVAVETLDELVARGAALPEPPVFEPAEGEDPLALLIYTSGSTGTPKGAMYSQRLVSRFWPRTPVVAQLPSISLHYMPLSHSYGRAVLCGTLAAGGTAHFTAHSDLSTLFEDIALARPTFLALVPRVCEMLLHESRRARDLAELRERVLGERLLVAVCGSAPLAPETRAFMEELLGFPLLDGYGSTEALSLMRDGVIQRPPVIDYKLVDVPELGYFTTDKPHPRGELLIRSESLVSGYYKRPELTAEMFDEQGYYKTGDVMAEIAPDRLVYVDRSKNVLKLSQGEFVAVAKLEAAFGASPYVKQIFVYGNSERSFLLAVVVPNAELVGRLDTVQALAEVKPLIADSLAAIAKESGLQSYEVPRDFIVETEPFTTGNGLLSEVGKLLRPKLKERYGERLEALYDQIAQGQADELRALREQAGERPVIDTVRKAAAAVVGSSGADFRPDANFADLGGDSLSALGFANLLQDVFGVETPVRIIIGPTASLAGIAEHIERALGGRPGEAAPNSASVHGAGAEVIRASDLTLDKFLDAQALEAAQSLPRPTGSHRTVLLTGANGWLGRFLALEQLQRLEATGGKLICLVRGKDAASARARVEEALGTDPALAARFAELAADRLEVVPGDVGEPKFGLDDRTWDRLAGEVDAVVHSGALVNHVLPYHQLFGSNVVGVAEIIRFAVASKLKPVAYLSTVAVAAGADPAAFDEDGDIREVVPQRPVDDSYANGYGNSKWAGEVLLREAHERTGLPVRVFRSDMILAHRQHTGQLNATDQFTRLILSLLATGLAPKSFYQLDPQGRRQRAHYDGIPVDFTAEAIVALAAEGNNGHRSYNVFNPHHDGVGLDEFVDWLIEAGHPITRIEDHATWFARFTTALRALPEKQRQLSLLPLAQVYSFPHPAVDGSPFRNAVFRADVQRARIGKDHDIPHLTRELILKYAADLAALGLL

SEQ ID NO: 40 - protein, 320 aa, Acidaminococcus fermentans (strain ATCC 25085 / DSM 20731 / VR4)
MSKVMTLKDAIAKYVHSGDHIALGGFTTDRKPYAAVFEILRQGITDLTGLGGAAGGDWDMLIGNGRVKAYINCYTANSGVTNVSRRFRKWFEAGKLTMEDYSQDVIYMMWHAAALGLPFLPVTLMQGSGLTDEWGISKEVRKTLDKVPDDKFKYIDNPFKPGEKVVAVPVPQVDVAIIHAQQASPDGTVRIWGGKFQDVDIAEAAKYTIVTCEEIISDEEIRRDPTKNDIPGMCVDAVVLAPYGAHPSQCYGLYDYDNPFLKVYDKVSKTQEDFDAFCKEWVFDLKDHDEYLNKLGATRLINLKVVPGLGYHIDMTKEDK

SEQ ID NO: 41 - protein, 266 aa, Acidaminococcus fermentans (strain ATCC 25085 / DSM 20731 / VR4)
MADYTNYTNKEMQAVTIAKQIKNGQVVTVGTGLPLIGASVAKRVYAPDCHIIVESGLMDCSPVEVPRSVGDLRFMAHCGCIWPNVRFVGFEINEYLHKANRLIAFIGGAQIDPYGNVNSTSIGDYHHPKTRFTGSGGANGIATYSNTIIMMQHEKRRFMNKIDYVTSPGWIDGPGGRERLGLPGDVGPQLVVTDKGILKFDEKTKRMYLAAYYPTSSPEDVLENTGFDLDVSKAVELEAPDPAVIKLIREEIDPGQAFIQVPTEAK

SEQ ID NO: 42 - protein, 341 aa, Burkholderia pseudomallei (strain 1710b)
MLTYFHPDQSLHHPRTYFSRGRMRMPQEVPERAARLVAAAFAMGFPVREPDDFGIAPIAAVHDTHYLRFLETVHREWKAMPEDWGDEAMSNIFVREPNALRGVLAQAARHLADGSCPVGEHTWRAAYWSAQSALAAAAAVRDGAPAAYALCRPPGHHARVDAAGGFCYLNNAAIAAQALRARHARVAVLDTDMHHGQGIQEIFYARRDVLYVSIHGDPTNFYPAVAGFDDERGAGEGLGYNVNLPMPHGSSEAAFFERVDDALRELRRFAPDALVLSLGFDVYRDDPQSQVAVTTDGFGRLGHLIGALRLPTVIVQEGGYHIESLEANARSFFGGFGALRG

SEQ ID NO: 43 - protein, 346 aa, Pseudomonas aeruginosa
  Pseudomonas aeruginosa (strain ATCC 15692 / DSM 22644 / CIP 104116 / JCM 14847 / LMG 12228 / 1C / PRS 101 / PAO1)
MLSVYSDDHRLHFGQSELVDGKLQPCFEMPSRADTVLARVKSQNLGEVIAPKDFGREPLLRLHDAAYLDFLQGAWARWTAEGHSGDLVSTTFPGRRLRRDGPIPTALMGELGYYSFDTEAPITAGTWQAIYSSAQVALTAQEHMRQGARSAFALCRPPGHHAGGDFMGGYCFLNNAAIATQAFLDQGARRVAILDVDYHHGNGTQDIFYRRDDVLFASIHGDPRVEYPYFLGYADERGEGAGEGCNHNYPLAHGSGWDLWSAALDDACVRIAGYAPDALVISLGVDTYKEDPISQFRLDSPDYLRMGERIARLGLPTLFIMEGGYAVEAIGINAVNVLQGYEGAAR

SEQ ID NO: 44 - protein, 341 aa, Mycoplana ramosa
MRVIFSEDHKLRNAKTELYGGELVPPFEAPFRAEWILAAVKEAGFDDVVAPARHGLETVLKVHDAGYLNFLETAWDRWKAAGYKGEAIATSFPVRRTSPRIPTDIEGQIGYYCNAAETAISPGTWEAALSSMASAIDGADLIAAGHKAAFSLCRPPGHHAGIDMFGGYCFINNAAVAAQRLLDKGAKKIAILDVDFHHGNGTQDIFYERGDVFFASLHGDPAEAFPHFLGYAEETGKGAGAGTTANYPMGRGTPYSVWGEALTDSLKRIAAFGAEAIVVSLGVDTFEQDPISFFKLTSPDYITMGRTIAASGVPLLVVMEGGYGVPEIGLNVANVLKGVAG

SEQ ID NO: 45 - protein, 344 aa, Pseudomonas aeruginosa
  Pseudomonas aeruginosa (strain ATCC 15692 / DSM 22644 / CIP 104116 / JCM 14847 / LMG 12228 / 1C / PRS 101 / PAO1)
MLTIYSDDHRLHHGRHELIGGQFTPCFEKPSRADMVLDRVKAVGLGEVRAPRDFGLEPIRRVHSEGFVRFLQNAWQDWLATGRSHDMLPIAWPTRRLRQTEPDNIDGRLGYYSFDAGAPITAGTWQAITSSANVALSGQSELANGARSVFSLCRPPGHHAAADYMGGYCFFNNAAIAAQAFLDRGAGRVAILDVDYHHGNGTQDIFYDRADVLFTSIHGDPRFEYPYFLGYADEKGNGVGTGYNFNYPLAAGSDWATWSQALQAAIRQIQAYAADALIVSLGVDTFKEDPISQFRLDSPDYLRMGEAIGKLGLATLFVMEGGYAVEEIGINAVNVLQGFEGVHR

SEQ ID NO: 46 - protein, 262 aa, Escherichia coli (strain K12)
MGFLSGKRILVTGVASKLSIAYGIAQAMHREGAELAFTYQNDKLKGRVEEFAAQLGSDIVLQCDVAEDASIDTMFAELGKVWPKFDGFVHSIGFAPGDQLDGDYVNAVTREGFKIAHDISSYSFVAMAKACRSMLNPGSALLTLSYLGAERAIPNYNVMGLAKASLEANVRYMANAMGPEGVRVNAISAGPIRTLAASGIKDFRKMLAHCEAVTPIRRTVTIEDVGNSAAFLCSDLSAGISGEVVHVDGGFSIAAMNELELK

SEQ ID NO: 47 - protein, 260 aa, Clostridium botulinum
  Clostridium botulinum (strain Hall / ATCC 3502 / NCTC 13319 / Type A)
MESKNILLDKKNHIAILSLNRESVLNALNTQVLKEINIILDDIENDEDIYVVIVTGKGKAFIAGADISEMKDKTPKEGRIFGELGQNICRKIETMEKPTIAAVNGYALGGGCELAMSCDIRIASEKAKFGQPEVGLGITPGFGGTQRLSRLVGLSKAKELILTTDIIKSQEALNIGLVNKVVPVESLLEEAIMLAEKIVSKPQSAVRYAKSAINRGYETDIETGMIIEKDLFGLCFATEDQKEGMGAFLEKRKPNFINKY

SEQ ID NO: 48 - protein, 134 aa, Aeromonas caviae
MSAQSLEVGQKARLSKRFGAAEVAAFAALSEDFNPLHLDPAFAATTAFERPIVHGMLLASLFSGLLGQQLPGKGSIYLGQSLSFKLPVFVGDEVTAEVEVTALREDKPIATLTTRIFTQGGALAVTGEAVVKLP

SEQ ID NO: 49 - protein, 261 aa, Clostridium acetobutylicum
  Clostridium acetobutylicum (strain ATCC 824 / DSM 792 / JCM 1419 / LMG 5710 / VKM B-1787)
MELNNVILEKEGKVAVVTINRPKALNALNSDTLKEMDYVIGEIENDSEVLAVILTGAGEKSFVAGADISEMKEMNTIEGRKFGILGNKVFRRLELLEKPVIAAVNGFALGGGCEIAMSCDIRIASSNARFGQPEVGLGITPGFGGTQRLSRLVGMGMAKQLIFTAQNIKADEALRIGLVNKVVEPSELMNTAKEIANKIVSNAPVAVKLSKQAINRGMQCDIDTALAFESEAFGECFSTEDQKDAMTAFIEKRKIEGFKNR

SEQ ID NO: 50 - protein, 296 aa, Bacillus subtilis (strain 168)
MIQDSMQFAAVESGLRFYQAYDQSLSLWPIESEAFYVSTRFGKTHIIASGPKDAPSLILLHGGLFSSAMWYPNIAAWSSQFRTYAVDIIGDKNKSIPSAAMETRADFAEWMKDVFDSLGLETAHLAGLSLGGSHIVNFLLRAPERVERAVVISPAEAFISFHPDVYKYAAELTGARGAESYIKWITGDSYDLHPLLQRQIVAGVEWQDEQRSLKPTENGFPYVFTDQELKSIQVPVLLMFGEHEAMYHQQMAFERASVLVPGIQAEIVKNAGHLLSLEQPEYVNQRVLSFLCGGIK

SEQ ID NO: 51 - protein, 326 aa, Streptomyces diastatochromogenes
MARFRTRLALLGSAAALAAGAVVPAQLAGAQPAAAAADLQWVALGDSYTAGVIRAAGDAIDYPRDGCERTDRSYPQVIERDLYGLFDLTNVSCGAATIENVSDTPQYPIGRHMPPFSEDPDHPFPPVPPQSEAVGPGTDVITVGVGGNTLGFADILTKCQELGGESGGEGTPCKGALGSGIKARLDKVSQGYDRMLTVLHERGPKAKILTVGYPTVIPENTADCGYGDLTKFGTITQGDLAWLRQDVLEPLNKTIEDSAATQEAADFVNLYAPSQGHSVCDADKWVEGILTVSPNQDPQLSFVHPNASGHRNAADHVEEAMLNAIS

SEQ ID NO: 52 - protein, 269 aa, Bacillus cereus (strain ATCC 10987 / NRS 248)
MINKTLLQKRFNVAAVSYDQYANVQKKMAHSLLSTLNRRYSTNSSIRILELGCGTGYVTEQLSNLFPKAQITAIDFAESMIAVAKTRQNVNNVTFYCEDIERLRLEETYDVIISNATFQWLNDLKQVITNLFRHLSIEGILLFSTFGQETFQELHASFQRAKEEKNIQNETSIGQRFYSKNQLRHICEIETGDVHVSETCYIERFTEVREFLHSIRKVGATNSNEESYCQSPSLFRAMLRIYERDFTGNEGIMATYHALFVHITKEGKR

SEQ ID NO: 53 - protein, 392 aa, Yarrowia lipolytica (strain CLIB 122 / E 150)
MSLREITSPDEIRDTRSFSHLEWGAFLSIDDYNHREEIVLGHTPMCKNRLKSWGLYIEDGTRVAACETLERPALVQCKDGKIKSTSTFSIGAVFTPKEHRGKGYASVMMKQMASGIPFKPTLTDADIIKATGVSDVDQTLRVTPLWSDVGTFYEKFGWIGTTDLQYVFEVDGSASQNGVNGTPNGTNGTNGVNGHTNGTNGHSSAVKYLSEEDVYRLADVEASSFASDFEKFPFKGSYKCGIVPDRTVYEWHLARAKFLAKFAKVPEPKVFGAQIGDSWMAWHHMYNARELVILRAKLAKAEDLVELIAAAKNHLCKDGFSDQINKIILWEQEREWNHIVDGLSYDAIDQAIEKSQGKREHRGSSIPAVMFVEYKLQKDAMEFVDHGKLTWC

SEQ ID NO: 54 - protein, 224 aa, Bacillus subtilis (strain 168)
MKIYGIYMDRPLSQEENERFMSFISPEKREKCRRFYHKEDAHRTLLGDVLVRSVISRQYQLDKSDIRFSTQEYGKPCIPDLPDAHFNISHSGRWVICAFDSQPIGIDIEKTKPISLEIAKRFFSKTEYSDLLAKDKDEQTDYFYHLWSMKESFIKQEGKGLSLPLDSFSVRLHQDGQVSIELPDSHSPCYIKTYEVDPGYKMAVCAAHPDFPEDITMVSYEELL

SEQ ID NO: 55 - protein, 222 aa, Nocardia iowensis
MIETILPAGVESAELLEYPEDLKAHPAEEHLIAKSVEKRRRDFIGARHCARLALAELGEPPVAIGKGERGAPIWPRGVVGSLTHCDGYRAAAVAHKMRFRSIGIDAEPHATLPEGVLDSVSLPPEREWLKTTDSALHLDRLLFCAKEATYKAWWPLTARWLGFEEAHITFEIEDGSADSGNGTFHSELLVPGQTNDGGTPLLSFDGRWLIADGFILTAIAYA

SEQ ID NO: 56 - protein, 352 aa, Streptomyces griseus
MSLIDDPEFDSHVVKLMAWHFGAETGSPFWLGKLAGLGFDPVTDVRGLADLTRFPDVSAELRSVPAQDLIPRGLSDRPFRVYDSGGTTGSPKRIVDSGYRSLVTEWARERLIANGVPADGNWLHLGPGGPHVIGFDTARYAALGGGVFYTVDLDPRWVKRLLSQGRGEESEAYVQHLLDQAETILESQEIAVLNTTPPLLEAICARPRLYELVRSGVRAIIWAGTSISRETLTQLDDVFFPAASVVGVYGNSLMGVAPQRSGRPGDAHRCVFEPYPETTRLHLVDEDGTPVAYGERGRVRLHLVSEEMFLPNVLERDTAIRVEPGEGSTVDGLADVQTYRSLDDVAIIEGVY

SEQ ID NO: 57 - protein, 456 aa, Streptomyces griseus
MSTVAPPAVVLDPRVRGRLVASSDRTRLPSVLGGDLADVGTAPRLLAVAALNEIRAHADGRPPASEVFTEAARLFATATLDGETPREYARRVCHATGLTATAVEQAVTDLTGELRALPATTAAELPATGFGDGFDTRWVPRGRTFAAVMASNHPVPNISWAQALFHGYSVLVKPGSRDPFTPARLLAALTAAGLPPDRAAFLPCSREVGAYLLREADRGIVYGGDSAVATWHQRESVAVRGPGRTKAFLDRAPDDAVIDHLALSASFDGGTRCTNLSAVLTTGPVEEVADRLAERLARLPSLPATDEAATLLVVNRARADGLREQVAALRASLTDHSARAGDPETVVELPDGSFLPRPVVLSADRADHPAVGTELPFPFVVVAPWAEADGVEPLRDSLVLNLLTDREELVEAAVREPSVRKVTRGPVLPWTATPGIPHDDNYTQFLLEPKGVVARR

SEQ ID NO: 58 - protein, 217 aa, Spongiibacter sp. IMCC21906
MTHFIQFLPGRISPRRALALLLVLLLQGALPRIVLADTILLLGDSLSAAYKIPVESSWPALLQDSIDEEHSLKNASVSGETTAGGLARLPALLAKNNTDILIIELGGNDGLRGYPLVRIRENIEKMIKLGQKKGAKVVLLGMHIPPNYGRRYADGFHNIYLSLAEENNTALLPFLLDGVAKQPRLMQGDGIHPTAEAQPIILQNVLSVLRPLLDSTN

SEQ ID NO: 59 - protein, 208 aa, Escherichia coli O6:H1 (strain CFT073 / ATCC 700928 / UPEC)
MMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 60 - protein, 134 aa, Escherichia coli (strain K12)
MNTTLFRWPVRVYYEDTDAGGVVYHASYVAFYERARTEMLRHHHFSQQALMAERVAFVVRKMTVEYYAPARLDDMLEIQTEITSMRGTSLVFTQRIVNAENTLLNEAEVLVVCVDPLKMKPRALPKSIVAEFKQ

SEQ ID NO: 61 - protein, 211 aa, Congregibacter litoralis KT71
MGLLLGLALLLTGQLARAESTAGERPRILVVGDSISAAYGMSLEQGWAALLERRLQTRWPGAQVINASISGDTSAGGARRLPKLLAEHSPDLVVIELGGNDGLRGYPTSKLEANLSFMAEAASTAGAEVLILPMEIPPNYGPRYTRSFRESFERAATDTGATLGPFLLDGIATEEQLMQQDGIHPTVEAQPMITDIVQPVIEALLALREAS

SEQ ID NO: 62 - protein, 415 aa, Cuphea hookeriana
MVAAAASSAFFPVPAPGASPKPGKFGNWPSSLSPSFKPKSIPNGGFQVKANDSAHPKANGSAVSLKSGSLNTQEDTSSSPPPRTFLHQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 63 - protein, 383 aa, Umbellularia californica
MVTTSLASAFFSMKAVMLAPDGSGIKPRSSGLQVRAGKEQNSCKMINGTKVKDTEGLKGRSTLHGWSMPLELITTIFSAAEKQWTNLVSKPPQLLDDHLGLHGLVFRRTFAIRCSEVGPDRSTSIVAVMNYLQEAACNHAESLGLLGDGFGETLEMSRRDLIWVVRRTHVVVERYPAWGDTVEVEAWIGAAGNIGMRRHFLVRDCKTGHILARCTSVSVMMNMRTRRLSKIPQEVRGEIDPLFIEKFAVKEGEIKKLQKFNDSTADYIQGGWTPRWNDLDVNQHVNNIKYVGWIFKSVPDSIYENHHLSSITLEYRRECTRGRALQSLTTVCGGSSEAGIICEHLLQLEDGSEVLRGRTDWRPKRTDSFEGISERFPQQEPHN

SEQ ID NO: 64 - protein, 172 aa, Bacillus subtilis (strain 168)
METPETRFCKESKVVKTSRVFPLDTNNHNTLFGGKLMSYIDDIASISAARHCRRETVTASMDSVDFLKPIGQKDSVCLESYVTWVGTSSMEVFVKVIKEHLMTGERELAATSFLTFVALDSNGKPVPVPRVVPETEEEIMLHNTAVQRANERKNRKRHSQALANALGTDKPW

SEQ ID NO: 65 - protein, 138 aa, Bacillus subtilis (strain 168)
MHVSKKEIEVRYAETDQMGIVYHANYLVWMEVGRTALIKDLGFLYSDMEKKGVLSPVVDINISYKKPLHYGETAVVHTWIEDYNGFKTVYGYHIYNPAGELSIKATSSHICVDKESFKPIQFRKAFPDWHTAYEKAKK

SEQ ID NO: 66 - protein, 126 aa, Bacillus subtilis (strain 168)
MDMKHTLLEALGIEIVENTAERCVAVMPVDHRTVQPFGYLHGGASVALAETAASAGAQNLIDHTTQACVGLEINANHLKSVKEGTVKAIAEPVHIGRTTIVYHIHIYDEQERLICISRCTLAVIKK

SEQ ID NO: 67 - protein, 140 aa, Homo sapiens
MTSMTQSLREVIKAMTKARNFERVLGKITLVSAAPGKVICEMKVEEEHTNAIGTLHGGLTATLVDNISTMALLCTERGAPGVSVDMNITYMSPAKLGEDIVITAHVLKQGKTLAFTSVDLTNKATGKLIAQGRHTKHLGN

SEQ ID NO: 68 - protein, 241 aa, Eubacterium rectale DSM 17629
MAFSFDSRIRYSEVDSSCRLSLTGLTNYFQDCSVFHSQSHDVGIRFLADNHIAWVLSSWQICINRLPLLNEQVKISTWAYGMKAFYGYRNFTLEDAGGSTLAYANSVWVLVDTRTGRPVKVPQEFADTYGLEPQLEMECAKRKLHIPDDMEKKGEIEVPQFFIDSNHHMNNEKYVMLAQQLLPNDFEISELRVEYRKEAKLGDTVISYVKYTSKSVTVVLADTDKKPYSVVEFLSKPVPGK

SEQ ID NO: 69 - protein, 261 aa, Lactobacillus plantarum
  Lactobacillus plantarum (strain ATCC BAA-793 / NCIMB 8826 / WCFS1)
MATLGANASLYSEQHRITYYECDRTGRATLTTLIDIAVLASEDQSDALGLTTEMVQSHGVGWVVTQYAIDITRMPRQDEVVTIAVRGSAYNPYFAYREFWIRDADGQQLAYITSIWVMMSQTTRRIVKILPELVAPYQSEVVKRIPRLPRPISFEATDTTITKPYHVRFFDIDPNRHVNNAHYFDWLVDTLPATFLLQHDLVHVDVRYENEVKYGQTVTAHANILPSEVADQVTTSHLIEVDDEKCCEVTIQWRTLPEPIQ

SEQ ID NO: 70 - protein, 268 aa, Desulfovibrio piezophilus
  Desulfovibrio piezophilus (strain DSM 21447 / JCM 15486 / C1TLV30)
MVSLHPFPSQLHKIVMTTNIDLAFEHLYPVQSYEPRMDGRIAIPSVCNYLQDIASRHADTLGFGYHDLEKCGHFWMLARLHVTMERLPRFGESCRIETWPSGNERLVALRDFLLHDEKGLIGKATTSWVTVNTTTHKPDNPETVLNRRFIPKRDRATIFPTKAIKRLKGGEHDIRLVARRSDMDINNHVNNVHYVEFCLEAIPRSWEEKNRCLGIDIQFRSESHAGDEYVSACAPADPDGPHATFLHSLTRLSDGREVVRMRSWWIQA

SEQ ID NO: 71 - protein, 250 aa, Streptococcus dysgalactiae subsp. equisimilis (strain GGS_124)
MGLSYREDIKLPFELCDVKSDIKFPLLLDYCLTVSGRQSAQLGRSNDYLLEQYGLIWIVTDYEATIHRLPHFQETITIETKALSYNKFFCYRQFYIYDQEGGLLVDILAYFALLNPDTRKVATIPEDLVAPFETDFVKKLHRVPKMPLLEQSIDRDYYVRYFDIDMNGHVNNSKYLDWMYDVLGCEFLKTHQPLKMTLKYVKEVSPGGQITSSYHLDQLTSYHQITSDGQLNAQAMIEWRAIKQTESEID

SEQ ID NO: 72 - protein, 249 aa, Terrisporobacter othiniensis
MERVFTKEYEVTYRDTDARGECFLTSYMNFMADCGLSQDEKYGFVIADMVKENHTWMLVDYEITIYKYVKYKEKLRAITYIEGMNKFYAVRYFKIYNDKDDLILEGKTLVILVDSKKRRPLSIPDEHYKAYGVEEKTPTIGRNKLKLSKCKNVDYKKEFNVRYSDIDLNLHVGNVTYLGWILETIPFEIMTDYKIYSVKIKYQKELTYGDKVSVKTEMEYNDNNISAYHEIINESEEVVALLETHWNEI

SEQ ID NO: 73 - protein, 260 aa, Thalassospira xiamenensis M-5 = DSM 17429
MTIQWDEIAKPALPANCGWRGTYRVRYSEIGDNGLAMLPALADYMQDAAGWGARILKLAYDDTVDKGMAWVLARMVIHVRRYPGNGEDIIVETWPSGVARRVATRDFRLIDSSGDVIAVAQSFWVMFDLLERRAASWPDWIEERLPKPPGPKLIEPPFRPPFTTDPLPEIDSIKARPSDLDLYGHVNNVRLMQWVLGATGADSKPDFHPESIDIQFRTECRVQERVTVRQKDGFAAITRDGDGVDLVRAHVVPKNRTALA

SEQ ID NO: 74 - protein, 246 aa, Cellulosilyticum lentocellum
  Cellulosilyticum lentocellum (strain ATCC 49066 / DSM 5427 / NCIMB 11756 / RHM5)
MSRLKENYQVDFDVVDFTGKLSINGLCSYMQTVAAKHATKLGINFYKNGEKPTYYWILSRVKYEIDTYPRWEDLVSLETYPGGYEKLFAVRLFDLTDEKGELIGRITGDYLLMDAEKGRPVRIKGATGPLSVLDFPYEGRKIDKIEVPEVVLREQIRKAYYSELDLNGHMNNAHYIRWTVDMLPLEVLKENEIVSLQINYNASITYGVETKLIIGKNEAGNYLVAGNSLDDSVNYFTSEIILRKNK

SEQ ID NO: 75 - protein, 253 aa, Clostridium thermocellum
  Clostridium thermocellum (strain ATCC 27405 / DSM 1237 / NBRC 103400 / NCIMB 10682 / NRRL B-4536 / VPI 7372)
MQKKRFSKKYEVHYYEINSMQEATLLSLLNYMEDCAISHSTSAGYGVNELLAADAGWVLYRWLIKIDRLPKLGETITVQTWASSFERFYGNREFIVLDGRDNPIVKASSVWIYFNIKKRKPMRIPLEMGDAYGIDETRALEEPFTDFDFDFEPKVIEEFTVKRSDIDTNSHVNNKKYVDWIMETVPQQIYDNYKVTSLQIIYKKESSLGSGIKAGCVIDEQNTDNPRLLHKIWDKNTGLELVSAETIWQKIQS

SEQ ID NO: 76 - protein, 251 aa, Thermovirga lienii
  Thermovirga lienii (strain ATCC BAA-1197 / DSM 17291 / Cas60314)
MYEHNFRISYSQAGALGRLKLTGAMNLCQDIADDHAERVGVSVADLLKQSKTWVLHRFKMTIQTMPQRGDLVTIKTWYRPEKNLYSLRNFEMLDCNGKKLLSVQTSWVVVDMNRGRPLRLDRVMPEAYDKNKDENLEVSFQELLLPEKVDVKKTIQVAVTDLDMNFHVNNVHYLRWALDTIPVEILKEYKPKGVEIAFKRPAFYGDSVISEVGIDKNSCSILCRHHIYGEKDGQSMAVISTEWEKISREER

SEQ ID NO: 77 - protein, 247 aa, Sediminispirochaeta smaragdinae
  Sediminispirochaeta smaragdinae (strain DSM 11293 / JCM 15392 / SEBR 4228)
MKQVSRYTTEHTVMYSETDARGVLSLPSFFALFQEAALLHAEELGFGETYSKQENLMWVLSRLLLEIDAFPKHRDRIRLSTWPKQPQGPFAIRDYILESEEGTVCARATSSWLLLKLDTMRPIRPQTIFANLSMEGIGLAVEGTAPKISEIDNDSKQEMEVTARYSDLDQNNHVNNTRYVRWFLDCYTPEEITTSGNLHFAINYLQAASYSDKLLLRRYDTESDSSVYGYLEDGTPSFSARIERKSD

SEQ ID NO: 78 - protein, 241 aa, Opitutus terrae (strain DSM 11246 / JCM 15787 / PB90-1)
MPEKLTLNASVLYADVDRTEVLLLRGVFKFLQEAAITHANQFDLGSRAMATRGESWVLNRMAVAVHRYPRYEETMRIETWSRGIKGFKGYREFRVFDAQGAPLFSGSSLWLYVNMRTKSIIRVPAELAAEFPKRDDGAFFPELESLEFAPPAADARRVPIAIRYSDVDVNAHVNNTAYLDFLQEALARAGLSPRPQSIRIKYARAIPAEAETVRVAIEPRGTGAAFAIEDHDTIFAIGEVD

SEQ ID NO: 79 - protein, 252 aa, Thermincola potens (strain JR)
MEPYQTSIPVHYYEINNHRQASPVAILNYLEEAAIRHSESVGWGIEKLLANSRGWLLTRWSLHMQKYPQWGETVNIETWPYKFERFYATREFRISDREGRVLGAATTLWVFFDLRRKRPVRIPPDIYDAYGTGAERMVADEFADLPVVDEPEIKLEFRVRLSDIDTNDHVNNTKYVEWLLETVPLSVHNGFLLSSVEIAYKKETSYGSTVLCGIKETEAGERQTTFLHIILDKDSGTELARARTVWQKRSKI

SEQ ID NO: 80 - protein, 245 aa, Clostridium sp. CAG:306
MLFTKEYEIKYYEQNVNGDLKESALLNFLQDIATLSAESLGFGPSFVFANNYAWVVLKYHIELFAPLRNLSSIVIKTEPRGIAKLYAYRDFELYTKDGQCIGKAVSTWVLIDICTRKLLNTQKILADFMAPYQKRETDLVYEKIDSPDELMYQEVFDVRFDDIDVNRHANNSNYIVWALETLPVDFRLKHSPKTIDIKYKKEIGINSRVLSEAQQILTDGNVQTLHVIKDEQNAQDLTSLKIVWQ

SEQ ID NO: 81 - protein, 208 aa, Citrobacter rodentium (strain ICC168)
MVNFNNVFRWHLPFLFLILFTCRSVAADTLLILGDSLSAGYRMSASAAWPALLNDKWHSKTTIVNASISGDTSGQALARLPALLKQHQPRWVLVELGGNDGLRGFSPAQTEQTLRTILQNVKAASAEPLLMQIRLPANYGRRYNETFSAIYPKLASEFDIPLLPFFMEEVYLKPQWMQDDGIHPNRDAQPFIADWMAKQLSPLVKYES

SEQ ID NO: 82 - protein, 202 aa, Vibrio shilonii AK1
MIRQLSYFVLIVISLASFHAKAATLLILGDSLSAGYNMRAEQSWPTMLSDELSSGDEPMKVINGSVSGDTTSNGLAKLPGLLKQHSPDYVLIELGANDGLRGFQPSIIKNNLASLIEMSQQAGSKVLLMQIRIPPNYGKRYASMFEGIYPALAQESGVPLLPFFLEQVIIKPEWMMEDGLHPKPEAQPFIAQFVAESMQPHL

SEQ ID NO: 83 - protein, 201 aa, Pseudomonas putida CSV86
MRVWLLSAGLALLCMAQNAAAGTVLIVGDSISAAFGLDTRQGWVALLEKRLKDEGFDDKVINASISGDTSAGGQARLPALLSAHKPSLVVLELGGNDGLRGQLPAQLQQNLASMIDKSRAAGAKVLLLGMQLPPNYGARYTKAFAQVYSDLAVQKNVPLVPFFLEGVGGHPELMQADGIHPAQGAQGRLLENAWPAIKPLL

SEQ ID NO: 84 - protein, 215 aa, Alteromonas australica
MFYSLRNIAFVFLLLIPTFAQSDQHDSDEKEPNAKLLILGDSLSAAYGLRQEEGWVSLLQNTWRDENIPIDIVNAAVSGETTDGGLARLPRLLTQHQPSHVLIELGGNDGLQGHNVKKIRSNLVALVKIAQSADAKVFLQDMQIPTNYGKRYTNMFGESFDRVGEELNVPVIPFFLQNIALDTSLMQRDGIHPNAEAQALIAEFMHRQLMPLFDN

SEQ ID NO: 85 - protein, 200 aa, Ferrimonas balearica (strain DSM 9799 / CCM 4581 / PAT)
MVRRSLLILMLCLYQPGAWADQPSILILGDSLSASYGMSEAEGWVKKLQQNLPDAQIINASVSGETSGGGLRRLPGLLQQHQPDWVFVELGGNDGLRGFQPTITENNIEQLITLSKASGAQVLLSEVMVPPNYGRRYAERFQQIYHGLAKEHEVELVPFFMTEIATDPNLMQADGIHPNREAQGRIAAFLLPWFEQAIAE

SEQ ID NO: 86 - protein, 233 aa, Unknown
  Description of Unknown: Marine sediment metagenome
MTVKALTTRLPAPGPQVRYFSALRSAVLCVFLLAAGFCASTSAESDDGVLLVFGDSLSAAYRMDERDGWVALLQQQLREESTALQVVNGSVSGETTAGGLARLPAMLDAHQPDIVMLELGGNDGLRGLPVTSIRQNLERMIQMSQQAGARVILAGIQIPPNYGPRYTAPFYAQYQELADEYGLVLIPFLLEGIADNPALMQDDGIHPTAAAQPMIVDTVWPVLQGVLTATDRP

SEQ ID NO: 87 - protein, 209 aa, Shimwellia blattae
  Shimwellia blattae (strain ATCC 29907 / DSM 4481 / JCM 1650 / NBRC 105725 / CDC 9005-74)
MMHFKNMLRWHLPFLLLVLLMCRTAAADTLLVLGDSLSAGYRMPAEEAWPALLDKQWEKRQIRVINASISGDTAAQGLARLPTLLAEHKPRWVVIELGGNDGLRGFPPAGIAATLSQIISQVKAARARPILVQIHLPANYGRRYNESFGAIYATLAASNDIPLLPFFMEEVYLKPQWMQDDGIHPNASAQPFIADWMAQHLNPLVNHDS

SEQ ID NO: 88 - protein, 244 aa, Clostridium sulfidigenes
MELNYKEQFTIKFHEGDFMGNVKLFTIMDYVQQVSEGHSQILGVDFQSMMNKGLFWVVSRVEITMERYPKVGEDITVETCLGGREKVFMKRRFKIKDKDGQVIGRVLIYYLIVDIETRLPQKPSMCPVDININVGDVIDNKLNKIKMPGEAIETVNRKLYYNDIDINNHVNNAKYISFIEDFFSLDWHRVKKISYMQLNFIKEIKFDDSLIMNKFIEDKESNSFCINGISEISEQEFFQCRLKF

SEQ ID NO: 89 - protein, 252 aa, Clostridium cellulolyticum
  Clostridium cellulolyticum (strain ATCC 35319 / DSM 5812 / JCM 6584 / H10)
MEPLSIYKKNYHVDYGDADFYKRLKLSYLFNYFQNIAGLHSENTNVGIRKLQNDYGAAWVMTRMLMDINRMPECNEEISIETWPVEPKKKMIDRNFIVRDMDGSILASAISTWVILDMEKREMVRIDSVIPPQYPEFLKSKAIDRKFDKLKPSGQLQPAYKKLVGFSDIDINGHVNNAKYIDYILDCFTVEKHGEYRVKSIQINYVNEAVAGDIISLYKDTVDMDGSDKAVYITGINEVDGKVNFESHIRVQ

SEQ ID NO: 90 - protein, 249 aa, Clostridium argentinense CDC 2741
MKNIHRENYKVKFNETDYSTKIKMHSLINYMQETSSIHAELLGAGYEELKKHNLFWVVSRLKINMKKYVNWNDEVIVETWPSGVDKMFFTRSFRIYDREENHIGDINAAYLLVAEDSMFPQRISKLPINIPTIENRFEPYERLEKIKFPKDDKVLVAKKKVRYNDIDLNLHVNNAKYIEWVEDCFPLEMYKDMRIETLQLNFIKEAKCGEKIFFYKYNDLEDENTCYIEGIEKQSESQIFQCKLTFNKL

SEQ ID NO: 91 - protein, 245 aa, Cryptobacterium curtum (strain ATCC 700683 / DSM 15641 / 12-3)
MTISASLFLEKDYRLRTGDFDRYRRLHPTAVLDLFQDIGGLQAEMMGIGYDAMAAQDVFWAVVRTAYQVEHTPAEHEVVKVSTWPHSPSRYSFQRDYALRSTDGSLLVRGTSEWVLMDMNTRSLTSVLDYYHGSLDFIDERMFAKKLRKIRDFTEEGSGLSITPRYSDVDQNGHVNNARYASFVLDALDPSAAGSIASFQIDFRHEVIEGTPLVVFTQVEGKDIQAKGLDSNGEIKFACKITAQA

SEQ ID NO: 92 - protein, 247 aa, Treponema primitia (strain ATCC BAA-887 / DSM 12427 / ZAS-2)
MDVWKESYPVGFTAVDESEGLTLAAAFDYFQEAARRHAEVLGVGQEPMVQAGQGWVLSRISVLVERRPRQGELITVSTWPRGWEKLFALRDFDIRDESDKPIVRARSCWLIVNIEKRRPLRPQATMEKLPLNEGRDALPGGGVGLAPLENLLKAGDRVAAYSDIDYNGHVNNARYVQWVQDIADPTALVQAKTLRLDINYLSEVKIHEPIELWTEPLPAESDAVYTLGVEGRRNGGAVFRAELRIKD

SEQ ID NO: 93 - protein, 200 aa, Oceanimonas sp. (strain GK1)
MLRILVLLLCLVSPTVLADTLLILGDSLSAGYRMRSDQAWPHLLAEQWRREGRQVTVINASVSGDTTQGGLQRLPPLLQRHQPSLVLLELGGNDGLRGLPPGLIERNLERLIALAGDAGARVILTDIQLPPNYGRRYLQQFEQVFSRLASQHQLPLLPFFVAPLMGEQGMMMDDGIHPTVKAQPLIARQVGEFLTPYLTP

SEQ ID NO: 94 - protein, 244 aa, Paenibacillus sp. IHBB 10380
MGNIWTEEHLIYSNEIDYKANCRLSNLLSLMQRAADGDVEHMGGTRDQMVAHHLGWMLTTIDLACERMPIFNETLKITTWNKGTKGPLWLRDFRIFDENNQEIAKACTLWALVDIDKRKVLRPSAYPFNINSNHEDSVGPVPDKLNISDEVELYHSYSITVRYSGIDSNGHLNNSRYADLCMDTLTQSELDTLSILGFHITYYHEVKSAEQIQVLRSDHLEGYIYFRGQSLEDERYFEACLHVG

SEQ ID NO: 95 - protein, 265 aa, Aerococcus viridans ATCC 11563 = CCUG 4311
MINIRHYQGGKRMGLLYQESVKVRHYHCNALGEMTLPAILDIMLIASNNQEATIPEAKEGFRQEGWAWIITQNQIDINRLPRYDEDIIAETEATTYNKFFSKRHYALKTRDGLVLAQAETTFALIDLNQRSIVRIPEIVAEWYQVEKEERPSRRKRLNKEIAVESKLDRFEVKFLDIDLNNHVNNTIYLRWITNSLGMEWFEKYTPTSFTVAYEKEMYLHQEGAVHSDISTVSEDLKSGDTFNSQHVIDSEDKAHCLTEITWQVK

SEQ ID NO: 96 - protein, 241 aa, Lactococcus raffinolactis 4877
MLTYKKKYTVPYYETDANGNMKLPSLFNIALQLSGEQSHSLGISDDWLKETYNYAWVVVEYDVTIQRLPRFSEIITMSTFAKSYNKFFCYRDFVFYAENGDTLLTINSTFVLIDTTSRKVAHVEDDIVAPYQSEKISKIVRGHKSTALSDTPLEKSYHVRFNDIDQNGHVNNSKYFDWMTDVLGYDFLSSHVPSRIHLKYSKEVLYGATVTSRVDLVGVQSFHEIVSEGKHAQAEMTWREK

SEQ ID NO: 97 - protein, 242 aa, Catabacter hongkongensis
MNTKLEQLYTIRAFDVDTKGKWRPSAILTRLQEIAEDHAIAVNAGRKELVEERGMAWMLTRLHLQMKQYPDLTDTIKVVTWPGKPTKLFFVRHSMFFSETGEELGRATSLWVLFNIRERFLCRTGDIGENYPYDLSHGRALPDPGKIKLPDEMQYMTTRTVAYSEVDMNGHLNNAKYADWICELFDISHLKKAYMDQFRINYIAEAYMGQKVDLYCKEIDGTWFVCGKTGNKTVFDASIQWK

SEQ ID NO: 98 - protein, 254 aa, Lactobacillus ruminis SPM0211
MESKGFSEKHRVTYYETDMNGTVGLGRLVDLMMLSCNDQSDAVGLSSEKVNQMGLGWIVTQNMIDIKRLPRRNETIYITTHAKSYNRYFCYRDFWIHDIRKQELAHMHTVFALMDQNERKIVRIPENLIEPYHSEYATKIERLPLPKELERIDRQKEYEVRFWDIDINQHVNNVHYFEWMLDALDLDFLIKYQPVSMNIEYKKEIRYGQKAVSQAQITMTGVETVTTFHEIKVNDELSCRAVCDWKLRKEEWIM

SEQ ID NO: 99 - protein, 248 aa, Clostridium sp. DMHC 10
MDKIISKKDYNIHFYEVNYDKKADITSIMSYLGDLATYQSEELGVGIDYLMRNKMAWVVYKWNVHMDKYPEYNDTITVTTIPYSIRKFYAYRKFEIFNKGEKIGEATSLWFLINTERRRPCRVPEDIYRAYGLRVEDDQQLEFEKLLLPSEISSEKSFDVRYSDIDTNKHVNNVKYVSWALENIPLDVVKNCSVSSIRVIYEKETSYGETITVQTQMKEIEDKYIFDHVIKNSEGEKLTLIKTEFLKA

SEQ ID NO: 100 - protein, 250 aa, Clostridiales bacterium oral taxon 876 str. F0540
MPGFVYEKEYEIHYYEIDYKRRALITSLVDFFGDIATVQSEQLGIGIEYLKENNLAWVLYKWNIDVVKYPLHGEKIIVKTCPYSMKKFYAYRTFEVLNSEGEVIATADSIWFLINIERRRPVRINEDVYRLYGLDYNDQNTLEIEDIKKPDKADLEKIFNVRYSDIDTNQHVNNAKYIAWAIETVPMEVVLNYTIKNLKVIYEKETTYGEIVKVITEIIHNDNTVICIHKIIDKEEKELTLIKTTWEKNF

SEQ ID NO: 101 - protein, 250 aa, Clostridium novyi (strain NT)
MSGIITEKQYEIHYYEAHLKQQATITNIIDFFTDVSTFQSEELGVGINYMMENNMAWILYKWDINVERYPRYREKILAVTEPYSIKKFYAYRKFYILDENRNIIASAKSTWLLIDTKKRRPLRISKEMVKAFGLENKEETLEIENVHKLPEENTEINFKVRYSDIDTNGHVNNEKYVAWMIESIPRDIILNYTLKNTKITYKKETMYGESIKVITGKIKEDEDKVKFVHNILRENGELLTEGETLWEKNK

SEQ ID NO: 102 - protein, 244 aa, Peptoniphilus harei ACS-146-V-Sch2b
MKIFCKEYEVMNFLSSDGDLKLNHLVSYLIETSNYQSIDLGLSNEKLLDMGYTWMIYKWKIKINRYPRSYEKIKIKTWASGFKNINAFREFEVYCQGEKIIEASAIFLLIDVEKRKAIKIPEVLAEIYGNNGNRIFKSIERVNEPSELEIANRFSYKILRRDLDFNNHVNNSVYLELIYEAVTDEYTHVKFKDINVNYINELKLGDEIVIDFYREEDRFYFFFKSKDQSQIYARICGVSETPIS

SEQ ID NO: 103 - protein, 246 aa, Lactobacillus brevis (strain ATCC 367 / JCM 1170)
MAANEFSETHRVVYYEADDTGQLTLAMLINLFVLVSEDQNDALGLSTAFVQSHGVGWVVTQYHLHIDELPRTGAQVTIKTRATAYNRYFAYREYWLLDDAGQVLAYGEGIWVTMSYATRKITTIPAEVMAPYHSEEQTRLPRLPRPDHFDEAVNQTLKPYTVRYFDIDGNGHVNNAHYFDWMLDVLPATFLRAHHPTDVKIRFENEVQYGHQVTSELSQAAALTTQHMIKVGDLTAVKATIQWDNR

SEQ ID NO: 104 - protein, 249 aa, Lactobacillus delbrueckii
MRYYKDYQLKYVDCGESGQLKLPRMIDLMMESSEGQLAPTLGGASAMKERGRGWVVTQYEFEFTSLPRAGQKVRVWTEAVGYNRFLSYRDFGIEDEAGKDLVIAHSQWVLFDLKSRKLLPSDDKIAEELGAPLLAKIPRFKKLRPKDDYKDEKVYRAYYYDLDSNHHVNNAHYLDWIVDSLPRDFVNSHEPKDLAIKFDKEIKYGDEVVCQVMQETEDSAVKTCHAITRQGELMALCEVNWQKMCFNRD

SEQ ID NO: 105 - protein, 246 aa, Clostridium perfringens
MGKAYEKVYEVTYGETDGRKDCRITSMMNFFSDCCLSQEEKNSMNYADNSSETTWVFFDYEIIVNRYPRYREKIKVKTYVESIRKFYSNRVFEAYDMDGALVARADVLAFLINKKTRRPARISDEEYEIHGLSKESSKLLRKKLNFEKFDKEDLEMNFHIRYLDIDLNMHVSNIKYVEWILETVPVDIVLNYKMKKIKIKFEKEITYGHNVIIKSKIIKGEDEVKVLHKVENEEGESITLAETYWY

SEQ ID NO: 106 - protein, 289 aa, Treponema azotonutricium
  Treponema azotonutricium (strain ATCC BAA-888 / DSM 13862 / ZAS-9)
MSGEFHKDILGLPFASVNDSIYKTMLDIIKETTPIRFGDVDRSNRLTLGAAFGYFQEAAIAHADRLGVGFDAFAKIGQGWILSRISVFMEKRPKFGEIVTVESWPRGWDMLFALRDYAIRDNSGKAIARGRANWLILDIEKRRPLRARDIMEKLPLNEGVDAFPAGTLNLKPKEGLAKTGERKAAYSDIDFYGHVNNARYIQWIQDMADPDMLDAADEIRLDINYVSEVLPGETVELWSAPLPALPDAPGIVRENYPASPEKAFAFEGRRTGAKGIQAVFCAELHLGKD

SEQ ID NO: 107 - protein, 243 aa, Clostridium hathewayi 12489931
MYTFGSRIRYSETDEYGKLTLTGIMNYLQDCSTFQSEDIGLGISYLTEHHQAWWLSSWQIVIDRYPALGEEVVIGTWPYDFKGFYGYRNFTICDPAGNYLVRANSVWFLFDTELGRPVKVKEENIRGYGRGDEKRLEMEYAPRKITVPAEYEEAECVTIAKHHIDTNHHVNNAQYVEIAREVLPSEIEVGELRVEYKKAAVCGDVVYPHVSRTDEGYTVSLCDEQGAAYAVIWLRGKTREDVR

SEQ ID NO: 108 - protein, 250 aa, Bacillus coagulans (strain 2-6)
MANGSSLYKGQYHIELRDVDFTKKLKLSALFSLFQDIASLAAEDLGYGIETLEKKYKVAWILTRIRVDILRHPTWDENITIETWPLQPSKIDFDRDFLVKDHTGAVIIKAASKWVVMGLNDRKIKRTESINIHYPENRTERAIEGKFGKFKDFGGLEPAYQKVIGYSDIDFNGHLNNSKYVDYIMDCFLPDFHKRHPIHTIEINFNQEALPGDSITLYKDISKMDEHELYVEGVNQTDHHTIFKSHITIH

SEQ ID NO: 109 - protein, 257 aa, Bdellovibrio bacteriovorus
  Bdellovibrio bacteriovorus (strain ATCC 15356 / DSM 50701 / NCIB 9529 / HD100)
MTNISNSPWVENFHITSLLVNPLGRLGLYGLLNLLQETAWIHAEKMGFGLLDMEKQGLFWVLTRQSLQMKTWPRFGENIQIQTWLRAPEGAFVAREFAILNQSGEEIGLCSTSWLALDRQSKKILPADNLRPWDQIAHARSTGINPEKIPVTGTYEKIAKYRVRNSDLDINQHVNNTKYAQWILDAIPYDLHKSLKLNTYSVNFLAETHLGDEVEVHRNCSSPDVQLASHGASAYKGLRVGDEKVLFTAVLGWEKRK

SEQ ID NO: 110 - protein, 292 aa, Treponema denticola
MIIDNKYTIRHKVLTGNIDGKCRATPMEFAILVQELAAGHYSTTGLSVPHLQKMGLTWVITKQHFEITEYPLWMDDLIVQTWAQPPKGFFCFRDFAFFYAKNGKKTSIDEAFEEKCRIEAGREKNLSIEEEFKELKQPIFRASSCWVILNSETGQPVKPDEKTMGNLAFNEDHLEGKVFAKIPACENRDTEERFRPNLLDIDMNSHVNNLNYLRWILSYMDADFCKGKLLKTLDTNFVSSAMYGEELICRSSRSENICIHSIIRAKDGSEVFKARSEWADEKALSRTLNLSD

SEQ ID NO: 111 - protein, 245 aa, Paenibacillus lactis 154
MVEKWTETYTIQSVDADFRGDCRWSSLLSIMQRAADKHIEALGIDREEMIERGLGWMLITLEADMTSIPRDMETIHVETWSRGSKGVLWHRDYRIMNDHGEQVGGARSVWTLVDIQKRKILRPSMFPYDVPIGQDSVGELPSKAVLPEGIELGEAYTTVVRYSGIDVNGHLNNARYADLCMDVLDEPELQGDKVTGFKITYNHEARLKDTIIVRRSGEIEGRIFVQGVSPEGTNFFEAALVKRKQ

SEQ ID NO: 112 - protein, 411 aa, Cuphea palustris
MVAAAASSACFPVPSPGASPKPGKLGNWSSSLSPSLKPKSIPNGGFQVKANASAHPKANGSAVTLKSGSLNTQEDTLSSSPPPRAFFNQLPDWSMLLTAITTVFVAPEKRWTMFDRKSKRPNMLMDSFGLERVVQDGLVFRQSFSIRSYEICADRTASIETVMNHVQETSLNQCKSIGLLDDGFGRSPEMCKRDLIWVVTRMKIMVNRYPTWGDTIEVSTWLSQSGKIGMGRDWLISDCNTGEILVRATSVYAMMNQKTRRFSKLPHEVRQEFAPHFLDSPPAIEDNDGKLQKFDVKTGDSIRKGLTPGWYDLDVNQHVSNVKYIGWILESMPTEVLETQELCSLTLEYRRECGRDSVLESVTSMDPSKVGDRFQYRHLLRLEDGADIMKGRTEWRPKNAGTNGAISTGKT

SEQ ID NO: 113 - protein, 132 aa, Escherichia coli (strain SMS-3-5 / SECEC)
MSTTHNVPQGDLVLRTLAMPADTNANGDIFGGWLMSQMDIGGAILAKEIAHGRVVTVRVEGMTFLRPVAVGDVVCCYARCVQKGTTSVSINIEVWVKKVASEPIGQRYKATEALFKYVAVDPEGKPRALPVE

SEQ ID NO: 114 - protein, 397 aa, Treponema denticola (strain ATCC 35405 / CIP 103919 / DSM 14222)
MIVKPMVRNNICLNAHPQGCKKGVEDQIEYTKKRITAEVKAGAKAPKNVLVLGCSNGYGLASRITAAFGYGAATIGVSFEKAGSETKYGTPGWYNNLAFDEAAKREGLYSVTIDGDAFSDEIKAQVIEEAKKKGIKFDLIVYSLASPVRTDPDTGIMHKSVLKPFGKTFTGKTVDPFTGELKEISAEPANDEEAAATVKVMGGEDWERWIKQLSKEGLLEEGCITLAYSYIGPEATQALYRKGTIGKAKEHLEATAHRLNKENPSIRAFVSVNKGLVTRASAVIPVIPLYLASLFKVMKEKGNHEGCIEQITRLYAERLYRKDGTIPVDEENRIRIDDWELEEDVQKAVSALMEKVTGENAESLTDLAGYRHDFLASNGFDVEGINYEAEVERFDRI

SEQ ID NO: 115 - protein, 539 aa, Euglena gracilis
MSCPASPSAAVVSAGALCLCVATVLLATGSNPTALSTASTRSPTSLVRGVDRGLMRPTTAAALTTMREVPQMAEGFSGEATSAWAAAGPQWAAPLVAAASSALALWWWAARRSVRRPLAALAELPTAVTHLAPPMAMFTTTAKVIQPKIRGFICTTTHPIGCEKRVQEEIAYARAHPPTSPGPKRVLVIGCSTGYGLSTRITAAFGYQAATLGVFLAGPPTKGRPAAAGWYNTVAFEKAALEAGLYARSLNGDAFDSTTKARTVEAIKRDLGTVDLVVYSIAAPKRTDPATGVLHKACLKPIGATYTNRTVNTDKAEVTDVSIEPASPEEIADTVKVMGGEDWELWIQALSEAGVLAEGAKTVAYSYIGPEMTWPVYWSGTIGEAKKDVEKAAKRITQQYGCPAYPVVAKALVTQASSAIPVVPLYICLLYRVMKEKGTHEGCIEQMVRLLTTKLYPENGAPIVDEAGRVRVDDWEMAEDVQQAVKDLWSQVSTANLKDISDFAGYQTEFLRLFGFGIDGVDYDQPVDVEADLPSAAQQ

SEQ ID NO: 116 - protein, 459 aa, Chromobacterium violaceum
  Chromobacterium violaceum (strain ATCC 12472 / DSM 30191 / JCM 1249 / NBRC 12614 / NCIMB 9131 / NCTC 9757)
MQKQRTTSQWRELDAAHHLHPFTDTASLNQAGARVMTRGEGVYLWDSEGNKIIDGMAGLWCVNVGYGRKDFAEAARRQMEELPFYNTFFKTTHPAVVELSSLLAEVTPAGFDRVFYTNSGSESVDTMIRMVRRYWDVQGKPEKKTLIGRWNGYHGSTIGGASLGGMKYMHEQGDLPIPGMAHIEQPWWYKHGKDMTPDEFGVVAARWLEEKILEIGADKVAAFVGEPIQGAGGVIVPPATYWPEIERICRKYDVLLVADEVICGFGRTGEWFGHQHFGFQPDLFTAAKGLSSGYLPIGAVFVGKRVAEGLIAGGDFNHGFTYSGHPVCAAVAHANVAALRDEGIVQRVKDDIGPYMQKRWRETFSRFEHVDDVRGVGMVQAFTLVKNKAKRELFPDFGEIGTLCRDIFFRNNLIMRACGDHIVSAPPLVMTRAEVDEMLAVAERCLEEFEQTLKARGLA

SEQ ID NO: 117 - protein, 464 aa, Thermomicrobium roseum (strain ATCC 27502 / DSM 5159 / P-2)
MTEVAAVHPEPRTAPDFEQEALKHVWIHSAEWIRLAEERGFRVFERAYGSTLVDVYGREFIDGLSGLWVVNAGHGRKEIAEAMAEQASKLAYVSSANHTTVPTVRLAHELALRLPGDLNRVFFCSGGSEAVESAIKIAKQVQAMRGFPKRYKIIARRGSYHGMTYGAMSLTQSRNEKFFGPFMYGVYYVPSPNRYRNDFGLEGEEGDLMCANYVEQEILYQDPETVAAVIGEPISTSNGVHVPSPKYWQRLREICDKYGVLLIMDEVINGFGRTGKLFAAEHFGVVPDLMTMAKGITSGYAPMGAVAVRDSVFQIFQEQKEVPLGHLLTFGGHAVAAAAALKNLEIFEREGLVQQSAEKGAYLLERLKELLRHPTVGDVRGLGLMCGIELVKSKATKEKWPRNSAFIKALERRMNEKGLLTRVWEIVHVAPPLVVTYEELDRIVTIIDEALTETENEFASEIAE

SEQ ID NO: 118 - protein, 457 aa, Nautella italica
MLTNDHLDAWDRDCFFHPSTHLAQHARGESANRVIRTASGVHIEDRDGTQLLDAFAGLYCVNVGYGRQEIADAIADQARELAYYHSYVGHGTEASITLAKMILDRSPSHMSKVYFGLGGSDANETNIKLVWYYNNILGRPQKKKIISRWRGYHGSGLMTGSLTGLELFHKKFDLPLAQVVHTDAPYYFRREDTNQSEAEFVAQCVASLEALIKAEGAETIAAFIGEPVLGTGGIVPPPAGYWDAIQAVLEKHDILLIADEVVTGFGRLGSMFGSDHYGMKPDIITIAKGLTSAYAPLSGSIVSDRMWKVLEQGTDENGPIGHGWTYSAHPIGAAAGVANLELIDKLGLVENAGTVGAYLQEGLRAALGAHAHVGDIRGEGMLAAVEFVEDRDDRRLFDPARKIGPQVAAALLEQDRVIARAMPQGDILGFAPPFCLTRQDADQIVAATQRAVETVLG

SEQ ID NO: 119 - protein, 459 aa, Escherichia coli (strain K12)
MNRLPSSASALACSAHALNLIEKRTLDHEEMKALNREVIEYFKEHVNPGFLEYRKSVTAGGDYGAVEWQAGSLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGAFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 120 - protein, 465 aa, Kiloniella spongiae
MRNTSSTIAPNSTAGRDIAYCLHPYTNARAHEEKGPLVITHGKGINVFDDQGNSYIEAMAGLWSTSLGFGEERLIEAANKQMKQLPYYHSFTHKTPIPPIELSEKLLSMAPVPMSKVFFANSGSEANDTVVKLVWYYNNAIGRPEKKKIISRIKGYHGVTVASASMTGLPANHTDFDLPIDNILHTSCPHYWRFGQGGESEDDFSTRMADDLEKMILDEGPETIAAFIGEPVMGAGGVIIPPKDYWAKIQAVLKKYDILLIADEVICGFGRTGNAFGCETFGMKPDIISVAKALSSSYLPISAVMITDELYQGIADNSAKIGVLGHGYTYSGHPVCAAVALETLKIYEERDLFVEAAKVGEYLQASLAQFKDHPLVGEVRGVGLIAAVELVQSKETKASFDPIGKVGTYLNERAIEEGLIIRNMGDSIAFCPPLIITTDEVDQTIERFNIALAKTLDWVKAEGMI

SEQ ID NO: 121 - protein, 457 aa, Haematobacter missouriensis
MMDTLPNSLAARDVKYLLHPNTNARMHEQNGPMVISRGDGIHVYDDAGKEYIEALAGLWSVAVGFGEKRLVEAAQRQMSTLPYYHIFSSKSHEPAIDLAETLVKMTPEHLTRVFYTNSGSEANDTVVKMIWYYNNVLGRPEKKKIIARKNGYHGITVASASLTGLPINHKDFDLPLPQMKHVTTPHFYRFGEEGETEEQFSDRLAQEIEDMILAEGPETVAAFIGEPVIGAGGVLVPPKGYWEKVQKVLKKYDILLVADEVIMGFGRSGKTFACEYYGIKPDFLVLSKQITSSYQPLAAIMLTDAIYQAIADGSQKNGAFGHGYTASGHPVAMAVAIENLKIIEERGLVANAEKVGAYMQKRLREFADHPLVGEVRGVGLIAAVELVADKATKAKFDPVGKAGAIYTRKSAENGLINRAIGDTICFCPPLIITEAQVDEMIARFSKSLDETAAELKG

SEQ ID NO: 122 - protein, 464 aa, Mesorhizobium sp. LC103
MLDKPPLSNLQARDVASVLHPYTPLHKLETMGPLVIERGEGVYVYDTQGKAYIEGMSGLWCAGLGFGDEEMIDAATEQLRTLPYYHLFGAKGTESAIELAEKLKEIAPVPISKVFFTSSGSEANDTQVKLAWYLNNALGRPNKKKIISRQKAYHGVTIMSASLTGLPYNHIGWDLPVDRVLHTDCPHYYRFGQEGESEAEFVNRMVKSLRDLIEREGPDTIAAMIAEPVMGAGGVIVPPEGYYPAIQAVLDEHDIIMISDEVINGFGRTGNWWGSQTLGMTPKTISAAKQMTSAYAPLGAVMVPEDIYQAYVSHSEKIGTFGHGFTYGGHPLGCALGVKAIEIYQKRDILGHVRSLSPQFERRMRKLTEHPLVGEARYCGLVGGVEIVADKKTKRPFDPKVGVGPQCAKFVEERGAILRAIGDTIALCPPMIIKEDELDELFDRLEKALDDTEAWVAKEGLRAL

SEQ ID NO: 123 - protein, 464 aa, Pseudomonas sp. 10-1B
MENSMSLNDLQQRDIDNLLHPYTNHHLHQSQGPHVITGGDGIYVTDDQGNRYIEGLAGLFCASLGFSEPRLAQAAFEQLQRMPFYHAFAHKSTQPGIELAERLLAMAPPSMSKVFFANSGSEANDTAVKLIWYYHNAIGQPQKKKIIARQRGYHGVTVASASLTGLPNNHRDFDLPIANILHTDCPHYYRYGLPGESEAAFVDRCVANLEALILHEGADTIAAFFAEPVMVSGGVILPPQGYFAKVQALLRKYDILFVVDEVICGFARTGNMFGWQTYDLQPDMISLAKQLSAAYMPISALLVNDKIDQALKAQSEKIGSFSHGFTYGGHPVAAAVALEAQKIYQERDIVGHVRRVAPRFQAGIRRLGEHPLIGEARGVGLVAGLEFVRNKQTRETFAPEQSAAAYAGRRAQAHGVITRGLGDTLSLCPALIIDEEQIDDLIVRIERALDDTLAWAREQGLVDA

SEQ ID NO: 124 - protein, 464 aa, Mesorhizobium alhagi CCNWXJ12-2
MLENPPLTNLQTRDIESLVHPYTPIHQLKSTGTVIMGRGKGVYVYDTQGRAYIEGMSGLWCAGLGFGDEEMIEAAIEQMRALPYYHIFGAKSSEPAIELAEKLKEIAPVPISKVFFTSSGSEANDTQVKLAWYMNNAMGRPNKKKIISRIKAYHGVTVMAASLTGLPSNHNGWDLPVDRVLHTDCPHHYRFGIEGESEAEFTARMAKSLRDLIEREGPDTIAAMIAEPVMGAGGVVIPPKGYYEAIQAVLDEHDIMLIADEVITGFGRTGNWWGSQTLNMRPKTISAAKQLTSAYAPLGAVMVPEDVYQAYVDHSATLGTFAHGFTYGGHPLSCALGVKAIEIYQERDIIGHVRKLMPVFEQRMKKISEHPLVGEARYCGLVGAAELVADKSSKRSFDPRNGVGPKTSKLIEENGAILRALGDIIAICPPMIISEAELNELFDRLETGLDQAEAWVSTEALRAA

SEQ ID NO: 125 - protein, 468 aa, Pseudomonas aeruginosa
  Pseudomonas aeruginosa (strain ATCC 15692 / DSM 22644 / CIP 104116 / JCM 14847 / LMG 12228 / 1C / PRS 101 / PAO1)
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGLGEAEFLDGLVDEFERKILELGADRVGAFISEPVFGSGGVIVPPAGYHRRMWELCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 126 - protein, 454 aa, Pseudomonas syringae pv. syringae (strain B728a)
MSANNPQTLEWQALSSEHHLAPFSDYKQLKEKGPRIITRAEGVYLWDSEGNKILDGMSGLWCVAIGYGREELADAASKQMRELPYYNLFFQTAHPPVLELAKAISDIAPEGMNHVFFTGSGSEGNDTMLRMVRHYWALKGQPNKKTIISRVNGYHGSTVAGASLGGMTYMHEQGDLPIPGVVHIPQPYWFGEGGDMTPDEFGIWAAEQLEKKILELGVENVGAFIAEPIQGAGGVIVPPDSYWPKIKEILSRYDILFAADEVICGFGRTSEWFGSDFYGLRPDMMTIAKGLTSGYVPMGGLIVRDEIVAVLNEGGDFNHGFTYSGHPVAAAVALENIRILREEKIVERVRSETAPYLQKRLRELSDHPLVGEVRGVGLLGAIELVKDKTTRERYTDKGAGMICRTFCFDNGLIMRAVGDTMIIAPPLVISFAQIDELVEKARTCLDLTLAVLQG

SEQ ID NO: 127 - protein, 467 aa, Rhodobacter sphaeroides
  Rhodobacter sphaeroides (strain ATCC 17023 / 2.4.1 / NCIB 8253 / DSM 158)
MTRNDATNAAGAVGAAMRDHILLPAQEMAKLGKSAQPVLTHAEGIYVHTEDGRRLIDGPAGMWCAQVGYGRREIVDAMAHQAMVLPYASPWYMATSPAARLAEKIATLTPGDLNRIFFTTGGSTAVDSALRFSEFYNNVLGRPQKKRIIVRYDGYHGSTALTAACTGRTGNWPNFDIAQDRISFLSSPNPRHAGNRSQEAFLDDLVQEFEDRIESLGPDTIAAFLAEPILASGGVIIPPAGYHARFKAICEKHDILYISDEVVTGFGRCGEWFASEKVFGVVPDIITFAKGVTSGYVPLGGLAISEAVLARISGENAKGSWFTNGYTYSNQPVACAAALANIELMEREGIVDQAREMADYFAAALASLRDLPGVAETRSVGLVGCVQCLLDPTRADGTAEDKAFTLKIDERCFELGLIVRPLGDLCVISPPLIISRAQIDEMVAIMRQAITEVSAAHGLTAKEPAAV

SEQ ID NO: 128 - protein, 453 aa, Vibrio fluvialis
MNKPQSWEARAETYSLYGFTDMPSLHQRGTVVVTHGEGPYIVDVNGRRYLDANSGLWNMVAGFDHKGLIDAAKAQYERFPGYHAFFGRMSDQTVMLSEKLVEVSPFDSGRVFYTNSGSEANDTMVKMLWFLHAAEGKPQKRKILTRWNAYHGVTAVSASMTGKPYNSVFGLPLPGFVHLTCPHYWRYGEEGETEEQFVARLARELEETIQREGADTIAGFFAEPVMGAGGVIPPAKGYFQAILPILRKYDIPVISDEVICGFGRTGNTWGCVTYDFTPDAIISSKNLTAGFFPMGAVILGPELSKRLETAIEAIEEFPHGFTASGHPVGCAIALKAIDVVMNEGLAENVRRLAPRFEERLKHIAERPNIGEYRGIGFMWALEAVKDKASKTPFDGNLSVSERIANTCTDLGLICRPLGQSVVLCPPFILTEAQMDEMFDKLEKALDKVFAEVA

SEQ ID NO: 129 - protein, 460 aa, Lutibaculum baratangense AMV1
MSPLSNLAVRDVETLIHPYTNLAQHRETGPLVLERGQGIRVYDSNGKDYIEGLAGLWCTSLGYGNEELVEAAAAQMRKLSFTHIFGGKSHDPAIELAEKLKEIAPAEISKVFFTSSGSEANDTQVKLVWYYNNALGRPEKKKIIARQRGYHGVTIASASLTGLPANHGDFDLPIKNIMHTDCPHPYRGMEAGESEEDFSRRLAQNLEEMILREGPETVAAFIAEPVMGAGGVIIPPKGYFPAIQEVLRKYDVLMIDDEVICGFGRLGTMFGAQTLDIRPDTVSVAKALSSAYQPIGAVMVNEAVYQAMVEESRKLGTFGHGYTYSGHPVAAAVAIKTLEIYERENIVGQVAAKAPHFARRIQGFADHPLVGDARALGLIGALELVANKETKAGFTKPGVAAKLASLCEAEGLILRAIFGETLAICPPLIITEAEIDELADRLGRALDQCEAWVAAEGLRA

SEQ ID NO: 130 - protein, 438 aa, Truepera radiovictrix
  Truepera radiovictrix (strain DSM 17093 / CIP 108686 / LMG 22925 / RQ-24)
MSNQSLAERRRHAVPRAAYSTHPIYPARAEGAYVWDEDGHKYLDWTVGIAVMNVGHSHPKVIEAVKKQAETFQHLCFAVGMNETYVRLAEKLNALAPGSAPKRTFLVNSGAEAVENAIKIARAATKRPAIVAFTHAFHGRTHMALSLTAKWNPYKMGFAPRAAEIYRAQYPYLYRNPWGARNEEELAERALAALKDQVKTTVGESEVAAFILEPVAGEGGFIPAPGAFLKGVAAYAREIGALWIDDEVQAGIGRTGAWWAVDHYGLEPDLITSAKALSSGFPLSAVIGKAEVMDQLSPGQIGSTFGGNPVSCAAALATLEVIEEEGLLERAREIGERAMARLRTLQAELSAIGDVRGLGAMVGIEFVKDDQKTPFPEAAQAVLEHARNDGLLLLTTGTYGNVIRLLPPIRMTDAELSEGLDKLEAALRTVLEPVVVGA

SEQ ID NO: 131 - protein, 456 aa, Aquamicrobium defluvii
MTAHPNSTEARDVRYHLHSYTNARKHEEVGPLVIEKGDGIYVEDASGKRYIEAMAGLWSVAVGFSEQRLVDAATNQMKKLPFYHTFTHKGHSPVVDLAEKLVSIAPVEMSKAYFTNSGSEANDTAMKMIWYRSNALGQPQRKKIISRKRGYHGVTIASASLTGLPNNQISFDLPIANVLHTGTPHHYRDALAGESEEAFATRLADELEQLILAEGPETVAAFIGEPVMGAGGVVVPPATYWEKIQAVLAKYDILLVADEVICGFGRTGNMFGCQTFGIRPDILVMSKQLSSSYMPISALLINEKVYGPLADESNRIGTFGHGFTAGGHPVSAAVALENLKLIEERDLVGNARTVGAHMQKRLHELADHELVGEVRGVGLIAGVELVADKAAKAPWKNVGALGTLVNGYIQENGVISRNMGDTLGFCPPLIITEKQVDQMVDAVKKALDTALPQVKG

SEQ ID NO: 132 - protein, 451 aa, Neorhizobium galegae bv. orientalis str. HAMBI 540
MTIQPNSIEARDKAYQLHSYTNARALERDGSLVIDRGEGIYVYDVNGNKYIEGMAGLWSVGVGFGESRLVEAAARQMAKLPYYHTFTLRSHGPSIDLAEKLIQMAPVPMSKAYFTNSGSEANDTAMKMVWYRSNALGKPEKKKIISRIKGYHGVTIASASLTGLPNNHRSFDLPLAGVFHTTCPHYRAFKQENETELAFVERCAKDLEDLILKEGPETVAAFIGEPVMGAGGVIVPPAGYWDAIQKVLRKYDILLIADEVICGFGRTGEMFGTTTYSLQPDIMTLSKQISSSYQPISALLINENVYGPLADESAKIGTFGHGVTAAGHPVAAAVALENLAIIEERDLVGNVRALAPKFQSRLKALESHPLAIEARGVGLIGALELKPREGFSAGQLGPKLLAIMLEKGLISRAIGDSLALCPPMIITESQIDTIFDTFEASLEAFAKQLAA

SEQ ID NO: 133 - protein, 462 aa, Microvirga sp. BSC39
MRGLPNSIQARDVEYVLHPVTNARKHEEIGPIVIDRGEGIYVYDDQGNRYLEALAGLWSVAVGFGEKRLVEAAARQMAKLPYYHTFSHKTNEPSVLLAERLVRMTPDRLKRAFFTNSGSEANDSVIKMVWYYNNARGLHQKKKFISRTNAYHGITLASGSLTGLPANQRDFDLPFVPVRHVTCPHHYRFAEPGESEEAFADRLAAELEAVILEEGPETVAAFIGEPLMGAGGVLPPPATYWDKIQAVCRKYDVLIVADEVINGFGRLGTMFACDYYGIDPDIMVLSKQITSSYQPLAAVMISQELYDGIADNSRKIGTFGHGFTASGHPVPAAVALENLDIIEEKNLVENARRVGEVMQVELRKLAGHPLVGEVRGVGLIAAVELVADKATKAKFDPVGKVGAHVFSRAHGNGLIIRAIGDVIAFCPPLIINEEQVHDMVKRFKLTLDETAQELLNRDVASM

SEQ ID NO: 134 - protein, 459 aa, Mesorhizobium sp. LC103
MNDMTNFHQTAEARDIAYHFHGYTNAERHMEVGPMIIEDGEGIYVFDNEGRRYIEGLAGLWSVGVGFKEQRLITALTEQAQKLPYYHNFGHKSHGPAIELAEQLIALAPVPMSKVFYTNSGSEANDTVLKMIWYRSNAMGKPEKKKVIARERGYHGVTIASASLTGLPNNHRSFDLPIDRILHTLSPHHWKDAKPGETEEAFATRCAEELDALIQREGPDTIAAFFAEPVMGAGGVVTPPATYFEKIQAVLARYDILFVADEVICGFGRTGQIFGSVTYDIRPDIMVMSKQITSSYVPFSAIMVNDRVFGPIAEESGRIGTFGHGFTAGGHPLGAAVALENLAIIKERDLVSNARNIGAHFRGRLEELKSSPLVGEVRGVGLIAAIELVNDKQAKSVETPGQLGGLMNAAMQRNGLISRNMTDAVAFCPPMIITQAQADDMFEIIAKSLREVETEIGVA

SEQ ID NO: 135 - protein, 460 aa, Starkeya novella
  Starkeya novella (strain ATCC 8093 / DSM 506 / CCM 1077 / IAM 12100 / NBRC 12443 / NCIB 9113)
MLTNLQARDVETLVHPYTNLVAVRETGPLILERGKGVWVHDVDGKPYLEGMAGLWCTALGYGNEELVEAAATQMRKLPFTHIFGGKSHDPAIELAEKLKEMAPVPISKVFFTCSGSEANDTQMKLVWYMNNALGRPKKKKIISRMRAYHGVTIAAASLTGLAGNHNDFDLPIAGVRHTTCPHYYRLAEAGESEEDFATRLAADLEALIIAEGPETVAAFIAEPVLGAGGVIVPPKTYYPKIQAVLEKYDVFFIADEVITGFGRLGTAFGCEAMEMKPHSISVAKALSSAYQPIGGVMIPEDMYQAMLEESRKLGSFGHGYTYSAHPVAAAVAVKTLEIYERESIFERVRAKIPHFGARRAALEDHPLVGEARGAGLVAGIELVADKKSKHQFDPKLGVAAKCVAFAQEEGLIVRNVFGDAVTICPPLVISPAEIDELFDRLTRALDKTLDWAVRENLLAA

SEQ ID NO: 136 - protein, 460 aa, Azospirillum lipoferum (strain 4B)
MTAPVSTAGNSAASRDKAFILHPYTNLDVHETQGPMIIERGEGVRVFDDGGRDYIEGMASLWCVSLGWGEERLVQAAAKQMRQLSSYHIFGHKSHEPGIDLAEKLIGLAPVPMSKVFFANSGSEANDTAIKLIWYYNNALGRPEKKKILSRQRAYHGVTVATASLTGLPNNHRDFDLPIARIIHGDCPHHYRNGLEGESKEAFATRLAEQLEALILAEGPDTIAAMFAEPIMGAGGVVVPPATYFAKIQPVLKKYDILLVADEVICGFGRTGNFWGSQTMGMQPDILTCAKQLSSGYLPISAVMVTDAIYRACVDESRKIGTFGHGYTYSAHPVAAAVALETLKIYEERDIVGHVRSVAPAFQNRLKALAAHPLVGEARGTGLIGALELVADKATKMPFDPPGRAGALVNGLAQDNGLIVRAMGDSIALCPPLVITEAEIHETFDRLTKALDAAVPVLRG

SEQ ID NO: 137 - protein, 464 aa, Variovorax sp. CF313
MNASIPTAALQAAHAERAANDIAAHLHPFTNLAAHPQVDPLVIERGDGIYVEDDQGRRYLEAMSGLWCVSLGFSNARLAKAGSDALHTLPCYHTFNHRSNAAAIALAEKLLSMAPVPMSKVFFANSGSEANDTAVKLVWYYHNAIGKPGKKKIIARRNAYHGVTVAAASLSGLVPNHRDFDLPIDRVLHVDCPHHYRYAEPGETEEAFATRLADALEQRILAEGPDTVGAFIAEPVMGAGGVLVPPATYFEKVQAVLRKYEVLLIADEVICGFCRTGEMFGSTTFGLRPDILTAAKALSSGYVPISAVMVSEQVHAAVAANSGKIGTFGHGFTYSGHPVTAAVALETLRIYEDEQVLAHVQAVAPQFQAGLRRYAGHSHVGEVRGVGLIGALELAADPAKRMPFDAAMKAGARLAELALQEGLIVRAMGDAVAFCPPLIITPAQIDEMFERFDRAMVRFEASLA

SEQ ID NO: 138 - protein, 459 aa, Thalassospira profundimaris WP0211
MNHRPNSLHMSDIAHSMHPYTNMRLHEEKGPMIMAEGNGARVTDSEGKEYIEGLAGLWSVAVGFSETRLADAAYAQLKRLPYYHSFAHKAHEPSIRLAEKLVEMTPEGLNRVFFTNSGSEANDTVVKMAWFLNNGLGRPEKKKFLSRTKAYHGITIASGSLTGLAGNQKDFDLPAIPVTHLSCPHFWRYGEEGETETEFTARLLKELEDTIIAEGPETIAAFIGEPVMGAGGVMTPPEGYWPGVVEICHKYDILVVSDEVINGFGRTGARFGCEKYGFTPDILVTSKQLTSSYMPLAAIVVNDKVYNAIADNTAKLGNFGHGFTGTGHPVACAVGLENLNIIEERDLMGNAKRLEPMFQDGLRAFADHPLIGEIRGVGLIAGLEMADKKTKQPFGKPGTVAAKVVALAAEEGLICRNVYDTVALCPPLIVTEDDVREIHARLGRALDRALDWAKSEGML

SEQ ID NO: 139 - protein, 256 aa, Escherichia coli (strain K12)
MNNIWWQTKGQGNVHLVLLHGWGLNAEVWRCIDEELSSHFTLHLVDLPGFGRSRGFGALSLADMAEAVLQQAPDKAIWLGWSLGGLVASQIALTHPERVQALVTVASSPCFSARDEWPGIKPDVLAGFQQQLSDDFQRTVERFLALQTMGTETARQDARALKKTVLALPMPEVDVLNGGLEILKTVDLRQPLQNVSMPFLRLYGYLDGLVPRKVVPMLDKLWPHSESYIFAKAAHAPFISHPAEFCHLLVALKQRV

SEQ ID NO: 140 - protein, 105 aa, Escherichia coli (strain K12)
MAEWSGEYISPYAEHGKKSEQVKKITVSIPLKVLKILTDERTRRQVNNLRHATNSELLCEAFLHAFTGQPLPDDADLRKERSDEIPEAAKEIMREMGINPETWEY

SEQ ID NO: 141 - protein, 673 aa, Rhodospirillum rubrum
MFTTTNPTFIRPTAACPMFSCCPTWAARRSKPEPPWASWPWIILTPISAAASRPTGSPDRPWSGRPSEREGKTMTDTRAEADLTEVWRAWAAWGEKSRTMWATALGGAAPPSSPSPSGPDPAVGGGPAVGGDAARAFLEGVLRPSQPVLDAQAAWARDIAALCQAAAKRLRGEEAAPVIEPAGDDNRFKDDAWTKDPLFDTLKQGYLLTARLVATTLENSGGDPACRQRLAFYGRQVVDALAPTNFAATNPLVRRTALESGGKSLLNGLENLLRDLERGGGRLRPTMSDETAFEVGRTLAMTPGKVVFQNALMQLILYAPTTPKVHKRPLLVVPPWINKFYILDLTEKNSLIKYMVDQGFSVFVISWVNPDAGLAETRFEDYLSQGPLAAMEVMTEITGQRALGLVGYCIGGTLTACTLAVLAARRDHRVKSATLLTTLVDFSEPGELGVFIDPPLLDALDDQMARDGGLDGDLLSMAFNMLRDNDLIWSVFINNYLLGKTPAAFDLLYWNGDSTRMPAAMQRYYLREMYQKNKLVQPGGLTVLGHALDLRRIRTPVYLLSARDDHIAPWTSTFKATGLYGGPLRFVLAGSGHIAGVINPPAKARYGYWTNADTSLEAESWLEGATPHGGSWWPDWAAWAAGYAGPKVAARDPTKGPRPPLEDAPGSYVKVRI

SEQ ID NO: 142 - protein, 317 aa, Geobacillus stearothermophilus
MKNNGGARVVVIGAGFVGASYVFALMNQGIADEIVLIDANESKAIGDAMDFNHGKVFAPKPVDIWHGDYDDCRDADLVVICAGANQKPGETRLDLVDKNIAIFRSIVESVMASGFQGLFLVATNPVDILTYATWKFSGLPHERVIGSGTILDTARFRFLLGEYFSVAPQNVHAYIIGEHGDTELPVWSQAYIGVMPIRKLVESKGEEAQKDLERIFVNVRDAAYQIIEKKGATYYGIAMGLARVTRAILHNENAILTVSAYLDGLYGERDVYIGVPAVINRNGIREVIEIELNDDEKNRFHHSAATLKSVLARAFTR

SEQ ID NO: 143 - protein, 255 aa, Escherichia coli (strain K12)
MRHPLVMGNWKLNGSRHMVHELVSNLRKELAGVAGCAVAIAPPEMYIDMAKREAEGSHIMLGAQNVDLNLSGAFTGETSAAMLKDIGAQYIIIGHSERRTYHKESDELIAKKFAVLKEQGLTPVLCIGETEAENEAGKTEEVCARQIDAVLKTQGAAAFEGAVIAYEPVWAIGTGKSATPAQAQAVHKFIRDHIAKVDANIAEQVIIQYGGSVNASNAAELFAQPDIDGALVGGASLKADAFAVIVKAAEAAKQA

SEQ ID NO: 144 - protein, 558 aa, Homo sapiens
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 145 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 146 - protein, 558 aa, Bos taurus
MYRYLGEALLLSRAGPAALGSASADSAALLGWARGQPAAAPQPGLVPPARRHYSEAAADREDDPNFFKMVEGFFDRGASIVEDKLVEDLKTRETEEQKRNRVRSILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGVDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCITVGESDGSIWNPDGIDPKELEDFKLQHGTILGFPKAKIYEGSILEVDCDILIPAASEKQLTKSNAPRVKAKIIAEGANGPTTPEADKIFLERNIMVIPDLYLNAGGVTVSYFEWLNNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFRVYNEAGVTFT

SEQ ID NO: 147 - protein, 379 aa, Aromatoleum aromaticum (strain EbN1)
MDFSFSDEQLQLRDVVRRFCDQEYPAERRGTAVSAEVAARRWRQMADMGLLGLPFDSACGGSGLSAVELMLVMEELGRSLASEPYFATVALGGALVAAAASPAQAQALLPRVVSGELTLALGFGEPDGRYELLPVEAEARPGSDGYRLNGHKTLVLNGDTADMLLIVARTAGAAHERDGVTLFLVDRKLHGVEVHGYSTLDGRRAADIVLRDACIPVDHVLGPVGEALPLLENVIERAVAALCAEATGALDALLALTVDYVKVRKQFGVPLATFQALQHRLVDMLIACEQARSMAVVAAMAIDDAGGDAAQRRRLVSAAKVQVGNAGRFVGQQAIQMHGAMGMTDECSVGHYVKRLMVINQLFGDVQYHLRRFAQETAA

SEQ ID NO: 148 - protein, 421 aa, Rattus norvegicus
MAAALRRGYKVLRSVSHFECRAQHTKPSLKQEPGLGFSFELTEQQKEFQTIARKFAREEIIPVAPDYDKSGEYPFPLIKRAWELGLINTHIPESCGGLGLGTFDACLITEELAYGCTGVQTAIEANSLGQMPVIIAGNDQQKKKYLGRMTEQPMMCAYCVTEPSAGSDVAGIKTKAEKKGDEYVINGQKMWITNGGKANWYFVLTRSNPDPKVPASKAFTGFIVEADTPGIHIGKKELNMGQRCSDTRGITFEDVRVPKENVLIGEGAGFKIAMGAFDRTRPTVAAGAVGLAQRALDEATKYALDRKTFGKLLVEHQGVSFLLAEMAMKVELARLSYQRAAWEVDSGRRNTYFASIAKAFAGDIANQLATDAVQIFGGYGFNTEYPVEKLMRDAKIYQIYEGTAQIQRLIIAREHIEKYKN

SEQ ID NO: 149 - protein, 399 aa, Kibdelosporangium sp. MJ126-NF4
MDPILASLLDMTRIAPLDLVAADDLFSEEERAIRDTVRKFCADRIRPHLAEWFEQGDLPARELAREMGDLGLLGMHLQGYGAAGTNAVSYGLACHELEAADSGVRSLVSVQGSLAMYAIYAYGSDEQKNEWLPRMVRGEAIGCFGLTEADFGSNPGGMRTTARKDGSDWVLNGTKMWITNGSIADVAVVWARAEEGIRGFVVPTGSKGFTANKVPGKLSLRASVTSELVLEDVRLPADAVLPKSKGLSSPLGCLTEARFGIIFGSIGAGRDCLEAAISYAGDREVFDKPLSAYQLTQAKLAEMAVELGKGMLLAVHIGRLKDAGTLKPELISMGKLNNVRTALQIAREARTILGANGITLEYPVMRHANNLESVLTYEGTSEVHLLVIGQALTGVSAFR

SEQ ID NO: 150 - protein, 346 aa, Saccharomyces cerevisiae
MNTKSLDFYEPLEIDGQKYIKMTKKEDLGVYEAGVTQEAFTAKDKYDYKGIVENLERYGLCIVPSFIEPSKCDQILEELDPHFYRHDAWQGSPFPKETTVVTRAVLHSPTVLKEVVSDRLFCDMANHFLNEENYFLTGNVIRKCSSGIQLNSGIVYKVGAGAGDQGYHREDHIHHTIHQARDSFQYGKETLLGVGVAFTDMNKANGATRVIIGSHLWGPHDSCGKFDKRMEFHVNAAKGDAVLFLGSLYHAASANHTLEDRIAGYFFMSQGYLKQEENLHFGTDPEFFKDMPLETLKLLGLTTSEPYCGHIDYKSPGHIANPNLFENEVEKGYYGETIKIIYDDKE

SEQ ID NO: 151 - protein, 652 aa, Escherichia coli (strain K12)
MSQIHKHTIPANIADRCLINPQQYEAMYQQSINVPDTFWGEQGKILDWIKPYQKVKNTSFAPGNVSIKWYEDGTLNLAANCLDRHLQENGDRTAIIWEGDDASQSKHISYKELHRDVCRFANTLLELGIKKGDVVAIYMPMVPEAAVAMLACARIGAVHSVIFGGFSPEAVAGRIIDSNSRLVITSDEGVRAGRSIPLKKNVDDALKNPNVTSVEHVVVLKRTGGKIDWQEGRDLWWHDLVEQASDQHQAEEMNAEDPLFILYTSGSTGKPKGVLHTTGGYLVYAALTFKYVFDYHPGDIYWCTADVGWVTGHSYLLYGPLACGATTLMFEGVPNWPTPARMAQVVDKHQVNILYTAPTAIRALMAEGDKAIEGTDRSSLRILGSVGEPINPEAWEWYWKKIGNEKCPVVDTWWQTETGGFMITPLPGATELKAGSATRPFFGVQPALVDNEGNPLEGATEGSLVITDSWPGQARTLFGDHERFEQTYFSTFKNMYFSGDGARRDEDGYYWITGRVDDVLNVSGHRLGTAEIESALVAHPKIAEAAVVGIPHNIKGQAIYAYVTLNHGEEPSPELYAEVRNWVRKEIGPLATPDVLHWTDSLPKTRSGKIMRRILRKIAAGDTSNLGDTSTLADPGVVEKLLEEKQAIAMPS

SEQ ID NO: 152 - protein, 483 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 153 - protein, 663 aa, Escherichia coli (strain K12)
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVEAGIADYWYKYVGLNGAIVGMTTFGESAPAELLFEEFGFTVDNVVAKAKELL

SEQ ID NO: 154 - protein, 715 aa, Escherichia coli (strain K12)
  MOD_RES (140)..(140): Selenocysteine
MKKVVTVCPYCASGCKINLVVDNGKIVRAEAAQGKTNQGTLCLKGYYGWDFINDTQILTPRLKTPMIRRQRGGKLEPVSWDEALNYVAERLSAIKEKYGPDAIQTTGSSRGTGNETNYVMQKFARAVIGTNNVDCCARVCHGPSVAGLHQSVGNGAMSNAINEIDNTDLVFVFGYNPADSHPIVANHVINAKRNGAKIIVCDPRKIETARIADMHIALKNGSNIALLNAMGHVIIEENLYDKAFVASRTEGFEEYRKIVEGYTPESVEDITGVSASEIRQAARMYAQAKSAAILWGMGVTQFYQGVETVRSLTSLAMLTGNLGKPHAGVNPVRGQNNVQGACDMGALPDTYPGYQYVKDPANREKFAKAWGVESLPAHTGYRISELPHRAAHGEVRAAYIMGEDPLQTDAELSAVRKAFEDLELVIVQDIFMTKTASAADVILPSTSWGEHEGVFTAADRGFQRFFKAVEPKWDLKTDWQIISEIATRMGYPMHYNNTQEIWDELRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 155 - protein, 331 aa, Escherichia coli (strain K12)
MTIKVGINGFGRIGRIVFRAAQKRSDIEIVAINDLLDADYMAYMLKYDSTHGRFDGTVEVKDGHLIVNGKKIRVTAERDPANLKWDEVGVDVVAEATGLFLTDETARKHITAGAKKVVMTGPSKDNTPMFVKGANFDKYAGQDIVSNASCTTNCLAPLAKVINDNFGIIEGLMTTVHATTATQKTVDGPSHKDWRGGRGASQNIIPSSTGAAKAVGKVLPELNGKLTGMAFRVPTPNVSVVDLTVRLEKAATYEQIKAAVKAAAEGEMKGVLGYTEDDVVSTDFNGEVCTSVFDAKAGIALNDNFVKLVSWYDNETGYSNKVLDLIAHISK

SEQ ID NO: 156 - protein, 565 aa, Escherichia coli (strain K12)
MEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASETLAQYSPLVLNGEGMVLPELKDIQKVSRAIAFAVGKMAQQQGVAVKTSAEALQQAIDDNFWQAEYRDYRRTSI

SEQ ID NO: 157 - protein, 759 aa, Escherichia coli (strain K12)
MDDQLKQSALDFHEFPVPGKIQVSPTKPLATQRDLALAYSPGVAAPCLEIEKDPLKAYKYTARGNLVAVISNGTAVLGLGNIGALAGKPVMEGKGVLFKKFAGIDVFDIEVDELDPDKFIEVVAALEPTFGGINLEDIKAPECFYIEQKLRERMNIPVFHDDQHGTAIISTAAILNGLRVVEKNISDVRMVVSGAGAAAIACMNLLVALGLQKHNIVVCDSKGVIYQGREPNMAETKAAYAVVDDGKRTLDDVIEGADIFLGCSGPKVLTQEMVKKMARAPMILALANPEPEILPPLAKEVRPDAIICTGRSDYPNQVNNVLCFPFIFRGALDVGATAINEEMKLAAVRAIAELAHAEQSEVVASAYGDQDLSFGPEYIIPKPFDPRLIVKIAPAVAKAAMESGVATRPIADFDVYIDKLTEFVYKTNLFMKPIFSQARKAPKRVVLPEGEEARVLHATQELVTLGLAKPILIGRPNVIEMRIQKLGLQIKAGVDFEIVNNESDPRFKEYWTEYFQIMKRRGVTQEQAQRALISNPTVIGAIMVQRGEADAMICGTVGDYHEHFSVVKNVFGYRDGVHTAGAMNALLLPSGNTFIADTYVNDEPDAEELAEITLMAAETVRRFGIEPRVALLSHSNFGSSDCPSSSKMRQALELVRERAPELMIDGEMHGDAALVEAIRNDRMPDSSLKGSANILVMPNMEAARISYNLLRVSSSEGVTVGPVLMGVAKPVHVLTPIASVRRIVNMVALAVVEAQTQPL

SEQ ID NO: 158 - protein, 491 aa, Escherichia coli (strain K12)
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFSRLGAMLDQKNRITINYFAMPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 159 - protein, 332 aa, Escherichia coli (strain K12)
MKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 160 - protein, 371 aa, Mycobacterium tuberculosis (strain ATCC 25618 / H37Rv)
MRVGIPTETKNNEFRVAITPAGVAELTRRGHEVLIQAGAGEGSAITDADFKAAGAQLVGTADQVWADADLLLKVKEPIAAEYGRLRHGQILFTFLHLAASRACTDALLDSGTTSIAYETVQTADGALPLLAPMSEVAGRLAAQVGAYHLMRTQGGRGVLMGGVPGVEPADVVVIGAGTAGYNAARIANGMGATVTVLDINIDKLRQLDAEFCGRIHTRYSSAYELEGAVKRADLVIGAVLVPGAKAPKLVSNSLVAHMKPGAVLVDIAIDQGGCFEGSRPTTYDHPTFAVHDTLFYCVANMPASVPKTSTYALTNATMPYVLELADHGWRAACRSNPALAKGLSTHEGALLSERVATDLGVPFTEPASVLA

SEQ ID NO: 161 - protein, 558 aa, Homo sapiens; identical to SEQ ID NO: 145

SEQ ID NO: 162 - protein, 381 aa, Bacillus methanolicus
MTNFFIPPASVIGRGAVKEVGTRLKQIGAKKALIVTDAFLHSTGLSEEVAKNIREAGLDVAIFPKAQPDPADTQVHEGVDVFKQENCDALVSIGGGSSHDTAKAIGLVAANGGRINDYQGVNSVEKPVVPVVAITTTAGTGSETTSLAVITDSARKVKMPVIDEKITPTVAIVDPELMVKKPAGLTIATGMDALSHAIEAYVAKGATPVTDAFAIQAMKLINEYLPKAVANGEDIEAREAMAYAQYMAGVAFNNGGLGLVHSISHQVGGVYKLQHGICNSVNMPHVCAFNLIAKTERFAHIAELLGENVSGLSTAAAAERAIVALERYNKNFGIPSGYAEMGVKEEDIELLAKNAFEDVCTQSNPRVATVQDIAQIIKNAL

SEQ ID NO: 163 - protein, 399 aa, Burkholderia pseudomallei (strain 1106a)
MSSNRGVVYQGPGKVEVRKIDYPKMVDPSGRAIGHGVILKVVSTNICGSDQHMVRGRTTAPVGLVLGHEITGEVIEVGRDVETLKIGDLVSVPFNVACGRCAMCKEQHTGVCLNVNPARAGGAYGYVDMGGWIGGQAEYVLVPYADFNLLKFPDRDRAMAKIRDLTCLSDILPTGYHGAVTAGVKPGSTVYVAGAGPVGMAAAASARLLGAACTIVGDMNAERLAHAKAMGFEVVDLSKDATLGEQIEQILGKPEIDCAVDCVGFEAHGHGSSGHAQEAPATVLNSLMEITRPAGAIGIPGLYVTDDPGAVDVAAKHGSLSIRFGLGWAKSHSFHTGQTPVLKYSRNLMQAILFDRLPIAEIVNVAVISLDDAPEGYKKFDGGAPRKFVIDPHGMLKAA

SEQ ID NO: 164 - protein, 384 aa, Escherichia coli (strain K12)
MAKHLFTSESVSEGHPDKIADQISDAVLDAILEQDPKARVACETYVKTGMVLVGGEITTSAWVDIEEITRNTVREIGYVHSDMGFDANSCAVLSAIGKQSPDINQGVDRADPLEQGAGDQGLMFGYATNETDVLMPAPITYAHRLVQRQAEVRKNGTLPWLRPDAKSQVTFQYDDGKIVGIDAVVLSTQHSEEIDQKSLQEAVMEEIIKPILPAEWLTSATKFFINPTGRFVIGGPMGDCGLTGRKIIVDTYGGMARHGGGAFSGKDPSKVDRSAAYAARYVAKNIVAAGLADRCEIQVSYAIGVAEPTSIMVETFGTEKVPSEQLTLLVREFFDLRPYGLIQMLDLLHPIYKETAAYGHFGREHFPWEKTDKAQLLRDAAGLK

SEQ ID NO: 165 - protein, 255 aa, Serratia marcescens
MTSANDTVNKQAVASAFSRAAGSYDAAAALQRDVGERLLGMGSSHPGEQLLDAGCGTGYFSRMWRERGKRVTALDLAPGMLDVARQRQAAHHYLLGDIEQVPLPDAAMDICFSSLVVQWCSDLPAALAELYRVTRPGGVILFSTLAAGSLQELGDAWQQVDGERHVNAFLPLTQIRTACAAYRHELVTELRTLNYPDVMTLMRSLKGIGATHLHQGREGGLMSRGRLAALQAAYPCRQGQFPLSYHLAYGVIYRE

SEQ ID NO: 166 - protein, 6 aa, Artificial Sequence
  Description of Artificial Sequence: Synthetic 6xHis tag
HHHHHH

SEQ ID NO: 167 - protein, 453 aa, Vibrio fluvialis; identical to SEQ ID NO: 128

SEQ ID NO: 168 - protein, 467 aa, Rhodospirillum centenum (strain ATCC 51521 / SW)
MPSTAPHLGNSIASRDIASLLHPYTNLKAHESVGPMVITGGRGVTVVDDAGREYIEGVAGLWCTSLGFDEPRLVEAAVRQLRTLPFYHAFAHKSHEPGIELAEKLVALAPVPMSKAFFACSGSEANDTAVKLVWYYNNALGRPQKKKIIGRIKAYHGVTVASASLTGLPNNHRDFDLPIDRILHTDCPHWYRFHEEGEDEEAFASRLAASLEALIQREGPETVAAFIAEPVMGAGGVIVPPRTYFEKIQAVLRKHDVLLIADEVICGFGRTGAMFGSETFGLKPDIMTMAKALTSAYMPLSAVLVSEPIYRACVAESEKIGVFGHGYTYSGHPVSCAVALETLKIYEERDIVAHTRAVGARLQEGLARYRSHPLVGEVRGVGLIAGVELVADKATRQPFDPKLGVAARLAGFAQGHGAILRPIGDTLGFSPPLIITPEEVDELVARFGRALDDTTAWLEHEHRFRPA

SEQ ID NO: 169 - protein, 454 aa, Unknown
  Description of Unknown: Marine sediment metagenome
MTVQPNSIEARDIAFHLHSYTNARKHETNGPVVIDKGEGVFVTDTDGNRYIEAMAGLWSVAVGFGEKRLVDAAAKQMGKLPYYHTFTHKSHSPAIELAEKLVAMAPVPMSKAYFTNSGSEANDTMMKLVRYRSNALGQPQKKKFISRMRGYHGVTLASASLTGLVNNHRDFDLPIEGVLHTTCPHYWREGRDGESEEDFATRCAEDLEAMIQAEGPETIAAFIGEPVMGAGGVVVPPATYWEKIQAVLKRHDILLVADEVICGFGRTGEMFGSQTYGIEPDIMTLSKALSSSYLPISALLINEKVYGPIADRSAEIGTLGTGYTASGHPVAAAVALENLKIIEERDLVGNAREMGTLMQCRLRELENHPLVGEVRGVGLIAAIELVTDKKAKVAMQPPGAMAAQAFAILQKNGVISRAIGDALAFCPPLIIEAGHIDTIVETTRRSLDELQASL

SEQ ID NO: 170 - protein, 417 aa, Acidimicrobium ferrooxidans
  Acidimicrobium ferrooxidans (strain DSM 10331 / JCM 15462 / NBRC 103882 / ICP)
MGRFWHPFGQLYESDTNPVVFVRGEGIWVYDDTGRRYLDATAALWYANVGHGRAEIADAIAAQARELAGYSTFGTFSNRPAEELAEFLSARSPMPESEVFFVSGGGDAVETAVKLARRYFSLVGQPERTVLISRTNGYHGTWGFGTSLGGIPANRTGFGELIPTTVQVPWDDVEAVEAAIVANGPERVAAVIAEPVIGAGGVYPPPPGYFEALGATCRRHGVLLIVDSVICGFGRLGTWFGIERLGVEPDLITFAKGVTSGYLPLGGVMVSGRVAAPFKQPGAPVFRHGPTYGGHPTCTAAGIANCRILEDEQILARGAVLEGELLARLRPLASSALVAEVRGGLGLLGAVELRSDLLAEHPDALARLARLALERGIIVRVLATSIALSPPLIIEPAEIGVIVEGLADALDALAAEL

SEQ ID NO: 171 - protein, 455 aa, Tistrella mobilis (strain KA081020-065)
MAYSPNSPEARDIAYHLHSYTDARRHEETGSVVLEKGDGVFVEDIHGNRYIEAMAGLWSVALGFSEKRLADAAARQMAKLPFAHTFSYKSNGPVIDLAEKLISLAPVPMSKVFFTNSGSEANDTILKLLWYRSNSMGQPQRKKIISRVRGYHGVTIASASLTGLPNNHRSFDLPIANVLHTGSPHHWKDANPGESEEDFATRRAEELEAMILAEGPETIMAFIGEPVMGAGGVVVPPATYWEKIQAVLAKYDILLIADEVICGFGRTGNMFGSQTYDMRPDIMTMSKQLSSSYLPISAFMINEKVYGPIADESHRIGVLGHGFTAGGHPVASAVALENLKIIEERDLVANAREMGERLRGRFHALEGHPLVGEVRGVGLIAAVELVTNKEAKTALEAPGALGGKVAAALQARGVIVRNMLDAIAFCPPLIIKAEEVDMIADRFEAVLNDVAAEVL

SEQ ID NO: 172 - protein, 459 aa, Pseudomonas taiwanensis SJ9
MSQSNILLAKKDVQHHLHPYTDARLHQDVGPLIIDRGEGVYVFDVEGKRYIEAMSGLWSVALGFSNERLVKAAEQQMRKLPFYHIFTHKGHGPSIELAEKLIEIAPVPMSKVFFTNSGSEANDTVVKMIWYRNNALGKPEKKKFISRLNAYHGITAVSASLTGLPVNQRGFDVPLPGFHHVSCPHFYRNGQPGETEEQFADRMAAELESVILREGPETIAAFYGEPLMGAGGVIVPPRTYWEKMQAVCRKYDILIVADEVICGFGRTGKMFGCETFGIQPDVMVISKQMSSSYQPIAAILINEKVFEGIADQSRALGTLGHGFTASGHPVASAVALENIKIIQEQNLVGHAAEMGELLRAKLAGFADHPMVGEVRGCGLIAAVELVTDRKTKAPFETVGRLGRFLAARAQAHGMITRPIGDSIAFCPPLISTKQEIQEIADIFGKAFEDTERWFSQGGK

SEQ ID NO: 173 - protein, 460 aa, Methylobacterium aquaticum
MLSNLATRDVETLIHPYTNLAAFRQTGPLVLERGHGVWVYDTDGRPYLEGMAGLWCTALGYSNEELVEAAREQMSRLPFTHLFSGRSHDPAIELAETLKELAPIPVSKVFFTSSGSEANDTQVKLTWYLNNALGRPQKKKIIGRHKGYHGVTVASASLTGLTANHADWDLPLPGFLHAACPHHYRGAEAGETEEAYSARLATELEEMILREGPETVAAFIAEPVMGAGGAIVPPKGYFAAIEPVLARYDVRFIADEVICGFGRLGTWFGSEALGMKPHSLSFAKALTSAYMPLGGVTVDETLYQAMQDQSRKIGTFGHGTTYSGHPVASAVALKTIEIYRRDKIIEGAAEKAPHFQRRLSALEEHPLVGEAKGMGLIGGLEIVADKATKRQYDPKAGVAARCVAFAQEEGLIVRFLTGDRVAVCPPLVIRPDEIDTLFDRLGTALDRTQAWIREQGLTAA

SEQ ID NO: 174 - protein, 438 aa, Candida tenuis
  Candida tenuis (strain ATCC 10573 / BCRC 21748 / CBS 615 / JCM 9827 / NBRC 10315 / NRRL Y-1498 / VKM Y-70)
MNSSKSQICLATERQYSAKNYTPMPVVFKKAIGCKVWDVDDNEYLDFGGSYCATNQGHSHPKIVQALIDQAQICALPSRAFTHNLYGDYIKFVCQYFDFEKALPLNGGSEAIEFAIKLARAWGYTKKGISQNEAIVLFAANNYHGRTLGSTSASTTPGARKNYGPFLPKVGPYYGSEGKFIRYNHIEDIEEAFKTDGPNIAAIVLESLQGEAGIYVPKDGYLQQVKRLCEEYNILYIADEVQMGAGRTGTLLSCEQDGIKPDVLVVAKSIGGGVYPTSLVLSSGEIMDCIEPNSHGATFSGSPLSCATSKVALEVLIEDNMIDNAKHLGKIMLDGLNSIREKSSIITDVRGRGLMAGFDIDESQLNGKKVWHVCMLLRSKGIICKMVHAKTIRWAPALVITEEELRFGLRMLEQTINEITALEIADIPDAVTFDYLRY

SEQ ID NO: 175 - protein, 458 aa, Tepidicaulis marinus
MSQTAQISNQTRRWQEMDARHHVHPFSDQAALAKKGARVITHAEGVYLYDSEGHKIIDGMAGLWCVNVGYGRSELAEAGYKALKELPYYNTFFQTTNPYTAELGERLAEVTPDGLDRFFFANSGSEANDSMVKIIRYYWSLQGKPEKKVFISRKQAYHGVTMTAASLSGISAMHPQAGLPLPNHAHIDFPYWYGMGGDMDPNEFGVHIAMKLEEKILEIGAENVAAFVAEPVQGAGGLIIPPDSYWPVIQEICHKYDILLHADEVICGFGRTGNWFGSHTYGIVPDTMAMAKGMTSGYQPLSAVALGPRVGDALHNSGEEWSHGFTYSGHPVASAVALANLDVLQKDKLVEKAGGETGEHFLKHLHALADHPIVGETRGVGLLGAIELVKDKKTRERFEGDTGGLCRDHCFENDLIMRAIGNTMVLSPPLSITKAELDELFTLARKALDATAKDLGAM

SEQ ID NO: 176 - protein, 404 aa, Firmicutes bacterium CAG:24
MGELMQQYIDEAEQDLLHTYNRYQVVLDRGDGVSLYDIEGKRYLDFVAGIAVFALGYHNAEYNDALKAQIDKVIHTSNYYYNVPAVEAARHLKKVSRMDRVFFTNSGAEAIEGAIKAARKYAYLKDGTTDHEIIAMNHSFHGRTMGALSVTGNPHYREAFEPGIGNIRFADLNDFDSVLACVNDKTCAILLETVQGEGGIYPVQEDFLKKVRALCDEKDILLILDEIQCGMGRTGYWYAWQKYGVKPDIMTTAKALGCGVPVGAFLMTEKVGQHSLTAGDHGTTYGGNPLACAAVAKVLDLFEENNILEHVREVSAYLEEKLDSLAAKYDFITDRRGMGLMQGLVFDRPVAPVINAALENGLILINAGTNIIRFVPPLVITDADVDEMIEILDSCLKTFQEQNA

SEQ ID NO: 177 - protein, 450 aa, Pseudooceanicola batsensis
  Pseudooceanicola batsensis (strain ATCC BAA-863 / DSM 15984 / KCTC 12145 / HTCC2597)
MKDDNFLKEHNARALWHPMGAPGDSMANPPVIISSASGSRIRDIDGHETVDGVGGLWCANLGYSNDAVKEAIAKQLHELPYYSAFAGCTNPSAIEASVAVQEFFAEDGIGRVFFTSGGSDSVDTCLRLARQYHQVKGAPTRTKFLSLKKGYHGTHFGGASVNGNNRFRIGYEPLLPGCFHLTAPHAYRNPYDEADPAALARKIAAEMVDEIEFQGPETIAAFIMEPILGAGGVIVPDPTFMGLMREICTRYGILMIADEVICGFGRTGDWTGSRHWGVRPDMMSVAKGITSAYFPVGAALISEEVAEVFEKDTSGAAAIWHGYTYSAHPVGAAAVTACLSETLRLDTRTNAAARGTQLYQGLLGLKEKYDIIGDVRGGHGLMTAIEFVTDRAKKTPMDAATVKTIHSRVYEAGAMVRPAPPNLLMSPPLIITEAEVRTIIEALDTAIGSV

SEQ ID NO: 178 - protein, 461 aa, Defluviimonas sp. 20V17
MNELSNSVAHADITTILHPYTDARMHEQKGPLVIEKGDGVHVIDQSGKRYIEAMSGLWSVAVGFSQTRLRDAAAAQMEKLPYYHTFASKSHEPSVRLAEKLVEMTPENLTRVFYTSSGSEANDTVIKLVWYMNNALGRPQKKKFLARNKAYHGITIASGSLTGLPGNHRDFDLPAIPVVHLTCPHLYRFGQEGETEAQFCARLLKEAEDTILAEGPETIAAFIGEPVMGAGGVMVPPEGYWQGIEALCRKYDILLVSDEVINGFGRTGARWGCEKMGFTPDILVTSKQLTSSYMPLAAIVFSEDIYNVIADNTHKLGGFGHGFTASGHPVACAVGLENLAIIEEQGLMENAAKMGERLQAGLAKLADHPLVGEVRGTGLIAAVELVADKATKRPFDPVGKVGGKVFEYGHEEGVIFRNLGDSIAVCPPLIVTEHDVDEIVRLMGIAIDRAADWARAEGLVA

SEQ ID NO: 179 - protein, 431 aa, Sphingobacterium spiritivorum ATCC 33861
MIKEATVHERLAKHILADGLPLVIDLEKSHDSYIVDIEGNEYLDMFSMFASSPIGYNHPHIVKNSDLLKKVAINKLALSDIYPREFADFVDTFERVAIPAELSYCFFIDGGALAVENALKAAFDWKTRLNISRGIQQEASEVIHFKQAFHGRTGYTLSLTNTKDPRKYMYFPKFDWPRITNPKLHFPLTEESVTETIKAEQQAIQEIEAAIAKNPDAIACLILEPIQAEGGDNHFRTEFFQELRRICDDHDILLILDEVQTGLALTGKMWAYEHYGIIPDLISFGKKSQVCGVLAHREKFDRVEKHVFKESSRINSTFGGNLVDMMRFKLILEVIEQENLVQQAESLGEYLLEKLEQLAKRHSQLSNVRGKGLLASFDFQTEQQRDEFVKRAMNNKLLILGCGDKSIRFRPHLTVTVEQLDKALALVEKSL

SEQ ID NO: 180 - protein, 443 aa, Ramlibacter tataouinensis
  Ramlibacter tataouinensis (strain ATCC BAA-407 / DSM 14655 / LMG 21543 / TTB310)
MAYNDFDTGNHWLPFTPNRHFKKEPRVFVAADGMHFTTHDGRQVVDGISSLWCVGAGHNRKPINEAIKKQLDTLDYATAFNAANDQAFLAAQKIAAMAPGDLNKVLFCNSGSEAADTSMKVALAYHRARGEGHRNIFIGRERGYHGVGFGGMSVGGIPANRKVYGTALLPRVDHMRFIHDPANAYIHNQEPVSQEDYLLELEQRILPLHSPENVAAIIVEPVAGSAGWYLPPKGYLKRLREICDKHGILLIFDEVITGFGRMGTSFGADFYGVVPDMLNFAKCVTNGVIPLGGVICRDKLYDTMMKTDAPEHVIEFFHGYTYSGHPVSCAAAIATLDLYQKEGLFPRAGEMGKVLGDAFHSTFKGLPNVVGIRSLGLAAAVELAPIAGLPGKRAYDIYLDCFRKGALVRPAGDVVVIAPPYVVEKSHIDQLVNTLADSIRQHA

SEQ ID NO: 181 - protein, 462 aa, Bradyrhizobium sp. DOA9
MVAKQLSNSLAHADISATLHPYTNARAHERQGPVIIDRGEGIYVYDDAGKEYIEGLAGLWSVAIGFDEPRIVEVAAAQMAKLPYYHTFSHKSHEPSIRLAEKLVGMTPEPLSRVFFTSSGSEANDTMIKMVWYMNNALGRPKKKKFLARHRAYHGVTVASGSLTGLPNNHKDFDLPVIPVRHLTCPHFYRFAQTEETEAEFSARLVSEAEATILEEGPDTIAAFVGEPLMAAGGVMPPPKGYWQGIEALCRKYDILLVADEVICGLGRLGTRFGCEHYHFTPDIMIVSKQLTSSYMPLAAVIFSETIYNAIADNTAKIGTFGHGFTASGHPVATAVALENLKIIEERDLVGNAARMGRILQARLGELAAHPLVGEVRGVGLIAGIELVSEKHTRRPFASAGEVGAAAFAAAQRHGLIVRAIGDTIALCPPLIINEDQVHELVARLGDALDDTAQWRSAENLN

SEQ ID NO: 182 - protein, 233 aa, Firmicutes bacterium CAG:449
MNYYQKELVLQEKDFINDELSPYSILNYFQDIAGIHADKIGLSHEELIKNDLVWVVLRNKYEIIKMPSINQKVILKTWPHQKGKIDFDREYAIYDENNNLLIKGLSKWILMNYKTRRISMFNNIKYSFECLEETNFENKFNKIEDFDINNFSFIETTTSENDLDINGHVNNASYARIVLNNIDFDITINHFEINYIKEIKANQKLKIYYLKKDNTYYIKAFNNEEVIFVLIVY

SEQ ID NO: 183 - protein, 240 aa, Clostridium sp. CAG:798
MAIIENKYHIGIKYVDKDRLLSLRGIILLFEDIACRHSDMVGYGINDVTKTHFSWVLLNWKIKVLSRINYGSIVTVKTWSRETSKLYTYRDFEIYDENNNLICIASSKWVLLSTETGHIIHITEEIKNAYLAENKTVFNESDLHKIVEPDNAEKTFSFTVRRRDIDINNHMNNLYYLDYALEALPEEVYSKFFNNVEIMYKYSAKLGETINCFYKEEEDGYYVMMKSATDNILHALVKLY

SEQ ID NO: 184 - protein, 250 aa, Clostridium ultunense Esp
MKATPLYIKDYKVEINHVDFKGDLKLSSLFTYCQDIAGLHAENLGMGREVLYTQHRVIWVLVRVRVDIIKYPKWKDILTLETWPQEPSRMGFDRDFLIKDKKGNILAKAVSTWVVIDVESRKLVRTKSVYTGYPLVVEKRAIDCKLGNLKSSGELETAYERTVRYSDIDVNEHLNNAKYLDFIMDSFSFEEHRRFNVKSVEISYSNEALLGETIKIYEDRSRIDSNIIYMEGIREGKDLVFKSQIEIEEK

SEQ ID NO: 185 - protein, 253 aa, Granulicatella elegans ATCC 700633
MTVDVICQIERTILPYECDWKENLLLSQALGMMMLASRKQQQQLQNPNLIYEKGYTWIVIQHEIEIQRMPKVDEEVIIETQAISYNKFFTYREYRILSKEREELFKCITTFAMLDMKARKIVSIDEEVVLEYPLSIGKEMRKATRIPKKDFSDATTGEYKIRINDIDANLHVNNARYFDFAFSELGMEFIEDHQLKQVVIKYEKEVLPESTISCSTLWEENTLESQERRQTYHLISQDGNRCANIQMKWEEIV

SEQ ID NO: 186 - protein, 154 aa, Haemophilus influenzae
  Haemophilus influenzae (strain ATCC 51907 / DSM 11121 / KW20 / Rd)
MSANFTDKNGRQSKGVLLLRTLAMPSDTNANGDIFGGWIMSQMDMGGAILAKEIAHGRVVTVAVESMNFIKPISVGDVVCCYGQCLKVGRSSIKIKVEVWVKKVASEPIGERYCVTDAVFTFVAVDNNGRSRTIPRENNQELEKALALISEQPL

SEQ ID NO: 187 - protein, 245 aa, Eggerthella sp. CAG:1427
MTIGYEQTYQLRTGDFDRYAHLLPSSILDVFQDVAGVNAEQVPGMTWKELTDAGLFWVVTRIKYEVIETPHLHEQVIARTWPLAPTRLGFQREYTMRKLDGTPLVKCSSDWILMDYKTRSFASARDFYNGPQDFSEEKVFEKKLRKIKTFEPEDTGETFQVHFVDIDINGHVNNSKYPNFVMNSLDLGEDETIKTFQIDYRHELRAGSTVRIHSKRDGNVITSMGISTEGDTAGECMFATQIELA

SEQ ID NO: 188 - protein, 200 aa, Vibrio mimicus
MIRLLSLVLFFCLSAASQASEKLLVLGDSLSAGYQMPIEKSWPSLLPDALLEHGQDVTVINGSISGDTTGNGLARLPQLLDQHTPDLVLIELGANDGLRGFPPKVITSNLSKMISLIKDSGANVVMMQIRVPPNYGKRYSDMFYDIYPKLAEHQQVQLMPFFLEHVITKPEWMMDDGLHPKPEAQPWIAEFVAQELVKHL

SEQ ID NO: 189 - protein, 211 aa, Sedimenticola thiotaurini
MKKLFLLLIFAMSNVPAAEPVILVLGDSLSAAYGIERSRGWVSLLQSRLQQAGYPHRVVNASISGDTTAGGLARLPRALEQFQPDILIIELGGNDGLRGLGNRQTRDHLDQMITLARASHSRPLLLGMMLPPNFGKAFTEKFLQIYRDLAEQRNVPLVPFFLAGVADRPEWMQSDGIHPTAEGQPLMLEHVWEQLQPMLEETSVHSDKSLK

SEQ ID NO: 190 - protein, 247 aa, Bacteroides finegoldii CL09T03C10
MSESNKIGTYKFVAEPFHVDFNGRLTMGVLGNHLLNCAGFHASDRGFGIASLNEDNYTWVLSRLAIELDEMPYQYEDFSVQTWVENVYRLFTDRNFAIMNKEGKKIGYARSVWAMISLNTRKPADLLALHGGSIVDYICDEPCPIEKPSRIKVTNTQPLATLTAKYSDIDINGHVNSIRYIEHILDLFPIDLYKTKRIRRFEMAYVAESYFGDELTFFCDEANENEFHVEVKKNGSEVVCRSKVIFE

SEQ ID NO: 191 - protein, 206 aa, Pseudoalteromonas sp. SW0106-04
MSASILRVFIVLLLVTKPLFAWADNQILVLGDSLSAAYGLKQHQGWVQLLQDTYEQQNTPTTLINASISGETTGGALRRLDAILKEHTPTHVLIELGGNDGLRGFPVTKMKANLHALIDKSREAGAEVALMQIRIPPNYGRRYTELFEQSFVDVAKEKQVTLMPFFVEQVATNGELMQNDNIHPNAEAQPILRDIMKTQISNWLTK

SEQ ID NO: 192 - protein, 200 aa, Vibrio mytili
MIRLLSLFLFFSLSTLAHANEKLLVLGDSLSAGYQMPIEKSWPSLLSNALLEHDQDVTVINGSISGDTTGNGLARLPQLLDQHTPDFVILELGANDGLRGFPPKLITANLSKMITMIKNSGAKVFMMQIRVPPNYGKRYSDMFYDIYPKLAEHQQVTLLPFFLEHVVTKPEWMMDDGLHPKPEAQPWIAEFVAQELIKHL

SEQ ID NO: 193 - protein, 201 aa, Pseudomonas fluorescens
MRVWFLSAGLALMCMAQNAAAGTVLIVGDSISAGFGLDTRLGWVSLLEQRLEQEGFDDKVVNASISGDTSAGGQARLPALLAEHKPDLVILELGGNDGLRGMPPTQLQQNLAAMIDSSRQSGAKVLLLGMQLPPNYGKRYTDAFAEVYGKLADDKKIPLVPFFLDGVGGHPDLMQADGLHPAAGAQGKLLENVWPTLKPLL

SEQ ID NO: 194 - protein, 201 aa, Pseudomonas stutzeri (strain A1501)
MRRWLKCGALALLCWTQGALAGTVLVVGDSISAAFGLETSQGWVHLLQERLVEGDESWRVVNASISGDTTAGGLARLDPLLEEHTPEVVILELGGNDGLRGQSPVQLKQNLADMIDRSREAGAEVLLLGMRMPPNLGQRYTRAFADAFDSLAQEKSVAYVPFLLEGVGGVAGMMQADGIHPTAEAQSQLLETVWPALEPLL

SEQ ID NO: 195 - protein, 248 aa, Halobacteriovorax marinus
  Halobacteriovorax marinus (strain ATCC BAA-682 / DSM 15412 / SJ)
MKSPVFKKKYQVSISNVNINKRLGLFGLLGYLQDIATLHAEIAGFGLDEMISSNSFWVLVRQEIRMNKFPKWNDEIEIQTWSRTPQGMYAFREFEFFLNDEKVGSCSTAWMILSGDTRRIKKPDFPIEKINPRLDSLLDYCAERIKVLDNFELVNEIKVRISDLDLNMHVNNTKYTQWVLDSIPIELHKSAKLRNYQINFLKEAHLGDEIDIYRASSAKDESAHDTQFKGIRRSDQSTIFYVNIIADT

SEQ ID NO: 196 - protein, 689 aa, Chromera velia CCMP2878
MGAQCSAKNSLTYSIPYGEPQAEDESALYANPYMPELAGCDGLKSCWENFEVAVSSTGDKPAVGTREKQADGTLGKYVWKSWKEVAETVANLHAGLQSLDAFPLQSFPEESVQQTFKFLGVTGKNREEYLETMLAAYRAGVCLVPLYDTLGENTYEYCINQTGLKTVIVGDLKIASKLLHVAKKCECFKIIVCMDAVSDELKQEANASGVTIHSFEEVCEIGKQKPVDPTPAQSDMEINTICYTSGTTGNPKGVLVTHRALLTALSTSDELFKKEGFKIDFNDTHISYLPYAHVMERAVTEICVRRGMRIAFYSGDTTKIVDDIQLARPTVFFSVPRLYTRIYDRILSQAAAAGGIKKSLFDRALESKLTELRSTGNFTHKLWDAIVFSKIKDVLGGRVRFLVTGSAPMAKEVQEVLKVCFCCPMMEAFGMTETACCGTATAALDPTTGHVGGVVPGILLKVKGIPEMGYSPNDRGENGELMPRGELMVKGAAVFPGYFKEPEKTKEALDADGWLRTGDVCVINPNGSFKIIDRAKNIFKLAQGEYVAPEKIENIYIQCESVAQAFVTGYGTEKVLVCVVVPDEGYAKNWAKEKGLEGDAASLSALCATHGDLEAEVFKQIDAIGKARGLSGIEKAKAVRLYAEPFSVENDLLTATFKLKRHQANKTFKAQIDEMYAELNAKEKARGGS

SEQ ID NO: 197 - protein, 668 aa, Cyberlindnera jadinii
MNFNQPVNPQPVPGSRVEGYSEIFTNDPPVVLDPSMDTLSKMWNNAVANFANFDCMGVRKFHNTRKQQLDTFFTYDSYAEVDRKKHNISCGIIHLVTHHPKYRELLSIAGKPEFVVGILSPNRYEWMLVDLATRDFSLTNTALYPTLGQQSSQYILSVTESPIIFLTKDQIPKILEIKPELPLLNILVSLDDFDHDDHDLFVRAQSLGVSLVDFRAVEKIGERHPLPKDFNPPTTDTIYTISFTSGTTGNPKGVLIPHEMAACGIISCTMGLESPFELPKGAKRRQFGENVDQHGVQVTALCHLPLAHIYEREISNYALMSGFRLGFPSSTNPAMFFDDLKSIKPHYLASVPRVYNKLDALLKAKVKRGTPPHVVRKTFGLDHCRYLVSGSAPLGVETIKYLKQTLDIGFSVCYGSTETFAGFFFGDAFEDVITNSCGHPSASVQIRLRDVPEMGYHTNETPMRGELMVKGPQVFSEYFKNPKATADSFDKDGWFHTGDIVSMDSERRVYIIDRVKNFFKLQQGEFVTPERIENIYLAHSPLLTQLFVHGDSLQNFLVGVAGISLEYVQEMFKQDFGVAISQDEVLGLLQDPKYKAMLIKQLNHHVSGADLQGFEKIHNIHVDLEPLRLEDEVLTPTMKIKRENAKKKFAPILEKLYTEGSLVVKQKL

SEQ ID NO: 198 - protein, 702 aa, Pestalotiopsis fici W106-1
MESYIEKARRYAQPPPPGAPQGVAVPNSKLPGRSAVYRHWRRGDELPDYFDPDLSSGYDMFEQTAKRQPDARCLGYRPYNGSTKSFGPYIWYSYDNVLKRSTDFGKGLAELLEANGVGGRQRPVGLWCANRPEWQFVDLGAMSQSLYSISLYETLGPAATEFLINHAEIPVVCASLEHIPALILAAPRCPSLKLIISLDPLTEEIDAPGTSRKELLSSLAAEKGLQVHDFRDVEKAGQASSRSLNRPRPDDIFTINYTSGTTGNPKGVVLRHSNAVAATVTCLTVYPMRSSDVLCSYLPLAHIYERFVEISAMYGGGSIGYFHGNPLELIDDLKLLRPTIFTSVPRLLNRMGSSIKAATIEQQGVKGALSRYIMETKMANIENDDPAKATNKHMVYDRIWGRKITAALGLDRTVHMMSGSAPLDGGLQQFLRIVFATEIVQGYGSTEMFAICLAQSAGDMSVRNCGGPAACVEVCLLDLPDMGYFSSDQPCPRGELLMRGPNVFSEYYKDDEETSKAFTEDGWFKTGDICAVDELGRFSIIDRRKNLLKLAQGEYISPEHIENVLLAQRPWLAQGYVHGDSAEAHLVGIFGVQPDIFCNFLNRTLGKECKPEDTDQLEAVLQEPEVRSAVVKELAMVGKSAKLNSYEIPRAVRLMIEPFTVENGLLTPTLKLKRPQTAKKFDHLIKEMYAETRKTSTLMAKL

SEQ ID NO: 199 - protein, 718 aa, Caenorhabditis elegans
MVDESDVKSALNGHDRPFTITLAIVLLKIVFFIYDVVTFIPFKIFADPAEKLEKSERVKAEPDNGDPTTPWKNVSAKDGLMNSSFEGIHDLGTQWEECVRRYGNQPCMGTREVLKVHKEKQSNGKIFEKWQMGDYHWRSYAQVDKRVNMIASGLTSLGQQEKEPIILFAETREEWMTTALACMKMNFPIATMYATLGDEAVQFAINEVGAKTIFTSEALISKVKKAMSNGATSIENIIFFDSVDPASRGESVDVDLPFTLLSFDQLLSRGEPYPVPTRSKKDDLAFIMYTSGTTGNPKGVMISHQNIVAVTAGQAFNIVLGPDDRYIGYLPLAHILEVCAEMVVFTKGVRIGYSSAQTLFDRAPKIMKGEHGDCWVLQPTLMACVPAVMDRIFKAVIDEVNANSELFKQLFKTCYERKRSRYEEGYTSFILNKLVFNRIGKLLGGKVRQILSGGAPLSPETQRFMNICFCCPVVQGYGLTETCGGGTIADIHDLSTGTVGPPLTCCEILLQEWAEAGYSPKNDPPQGEILISGPNVALGYFKNDEKTKEEFVKVNGKTFFATGDIGEFREDGSLKIIDRKKDLLKLAHGEYISLGKVETNLLTNPNVDNVCVYGDSNKSFLVALVVPNQKNLTQLASKAGASNDNFEKLCEDKKVVEALQKELAQYGASKLQRVEIPQKIFICHEPWTPASGLLTEALKLKRKNIEKAFRKELDELYK

SEQ ID NO: 200 - protein, 663 aa, Tetrahymena thermophila (strain SB210)
MGANQSSRIYNVPIDEKKDGYSQIMRHPKYIDKLEYKPIPEIDNVQDLVLHGYSNSKEMNFFGKKNPVSNEFEYMTYDQVIEQAKQLGSAVKNLQFLKESSEQSNQKMELIGIYSKNRIEWGIADIANSLYGYTMVPLYDSLGPDSISYVLANSEITTCYCSAASVLTLSKTKDLHHLKNIISFDHVSEDLIELVKQRGIVVHLFKDIVEKGSLNVLPLPKLTRDTIFTFCYTSGTTGNPKSAMISHKNILASVTNYDKSDCFLTQDDVHLSYLPLPHIYERFINVYCWFKGTKIAFYSGDVHKIQEDIIASKPTCFSAVPRLLNRFYDAINSKLNQATGFQKILIQHALQTKLENIQKNGVYTHILYDKIIFNKIREQFGGRIRQLVCGSAPTSPKVFDFFKAVLSCSVIEGFGQTELSGVVTIQVKADPKMGNVGGIGPSSELKLEDVPEMEYLSTDKDELGNPKPRGEICVRGYNVFSGYYKDEEKTKEAIDQEGWFHTGDIGEIIPNGGLKIIDRKKNLFKLSQAEYVSPEKVENIYVRARGVQEVYIHGESLYNYCIGIIVPSQEELLKIAAELNISETDIASLCKNQQIISWYIKTIHNLGKHEGLFSFEQPKKIYLEPKSFLVIGCVTNSFKLQRHHAKNYFKNIIQELYNNNNNQ

SEQ ID NO: 201 - protein, 665 aa, Auxenochlorella protothecoides
MSTFPPLDAQCVVLPEKLNAPGPWTVRRNANFPEALIDSFDGEESHVRTCYDLLEHSVVKYPDSPYLGTRSVDARGAPGPYAWLSYSQVGEARTQIGSGLAHLGVRPGSNVGLFSTNCADWVLVDAALHAYACVSVPLYDTLGADVVQFVNNHAELAAVACSAATLPALLETLPASPTVAVVVVYAAPAGFRMPATPPGSAARLVSLDRLRALGMKHPSPHVPPSPADTALINYTSGTTGMPKGVVLTHANIVASIAGQIRSTAVLATIDATERHISYLPLAHIFERVTYMSVTHRGGAIGFFRGDVLTLLEDIQALRPTYFPSVPRLWNRIYDRIMAQVAASSPVKRRLFETAYAYKKRHMAAGDMTGGPWAGFWNRLVFNKIKQAVGGEVRMMVSGASALSPEVFEFMRIVFDCVVIEGYGMTETTSGATISIPGDPVIGHVGIPTPACEVKLADVPEMGYTNADLPRPRGEICVRGPLRFKEYYKDPENTRETIDEEGWLHTGDIGTWLPGERLKIIDRKKNIFKLSQGEYVAPEKIENIYVRSPYVAQVFVHGDSLRSCIVGVVVPDPEVLLPWAKQRGLPQDLATLCEDEQVKAMIQKSLSEEARVAKLKGFEQVADIVLTPVPFSVETGTMTPTFKLKRPQLREAYAPALEAMYARLPM

SEQ ID NO: 202 - protein, 694 aa, Lichtheimia corymbifera JMRC:FSU:9682
MVTLTMDKQTIEIPNDVPGESPILRRTPELMDSFVPGINNIYDLFYNGYKLSRDQPCLGERPILDRTTGERAKQFEWQTYEQVAARVDNFGSGLKHVLQQIGESRPKQIPIGIWSVNRPEWHIVDWACAAHSLYVVALYDTLGPDTVEYVVNHAEIQVVVCTKEHVTDLLKLRSKLPQLKAIISFDTLEKEQSQALHAWAEEKDLLLVEFANVEQHGKENPVPHNPAQRSDLACIMYTSGTTGKSKGVMLTQGNFVAAVSGAIYNVKSSPADVGISYLPLGHIYGRVADAFTVAGGASLGFFSGKVDNLLEDMQILKPTLFNTVPRLLNRIYTGIVQSTLQAPGMMKKSTMSLIWNCSLGITDVGPKGALFRKAIATKLENLEQGKGTQHPVYDRLLFDKVRQVLGGRVRFINTGAAPLGKEVMQLLRVTLLADIRESYGATESCASLTMQIEGDPKPGCIGIPAPCNEMKLIDVPEMNYLTTDKPYARGEICVRGYNVSLGYYKDEEKTKEAFDKDGFYHTGDIGMIDERGTFMVIDRKKNIFKLSQGEYIAPEKIENIYARDILVSQIFVYGDSVQSCLVAIVVPDPIELGKLAQEKLPKLTSLSYEELCNNPEVHIAVLERMMENGKRAEMRGFEFVKAIHLDSKPFTVENNLLTPSLKLKRPEARKFFQKEIEQLYQKLSNSSAGSAARL

SEQ ID NO: 203 - protein, 594 aa, Labilithrix luteola
MDISRFLDLRIAPRAVFDALEERKTRARFMVPTAPGSNEWRPVTWGAFAQEIRELALFLSTVLSSGDRGAVYAPNRVEWASAALAIQAAGGVIVPIYPASTPDQLSYVASHSDAKVIFVDTAPLLTRLFATWNSTPGVEKIVVLDDGIDVARVYESAREKGIPVPSLDAVERKVLSIGKARGIGAARDQEDPQAFERTMAAISLDQAGMMLYTSGTSGNPKGVPLTHRNVAVNGLDWLKCNYPLLEEGDVDILWLPMSHIFGFGEMCLGNTLGWTSYLADPATCLGRLPEVTPNIFMSVPSHWEKLALMAMHEPTPQARLDKFKAATGGKLRFCLSGGAGLKREVKDFFYSCGVLIVEGYGLTETSPTLTLNRPDAFRFDTVGKTLPSVELRLADDGEILARGASVFGGYHKDPEATREAFTEDGWFKTGDVGRFTDDGFLQIIDRKKDILVTAGGKNVPPANIEIRFQDDPLFAHVVVYGDAKKYLVAGVWLNEEAMSSQLASVPKDQQESARRDLVQKRIDHVNASLASYETIKKFSIIGEPLTVEAGLLTPSLKMRRKKVYEHFHGIFEGMFEDTQGKGAASSTASQGSGA

SEQ ID NO: 204 - protein, 734 aa, Geotrichum candidum
MSATLNGTQFPPEVAARLRTYPIATDPSVNANTPLITDPVTVKPYKIGKPQAVPVPGSKVDGFSEVYRNAHCPDRLVTTVHPKITTVVEAFDACVSEYKNEKALGERVFDGKTKTWSKIYQYETYGTIAKRRLDIGKGISKVVQDVTGFDSRQTPYCLGLYGPNCSNWILTDLAAQTQSIPTVCLYDTLGPDSTRYIMTLTEMPAIVCSVAHIPFVLNIKDELPNLKVIIAMNPINNPDIVDKPGQSKKDVLTAWAKKSGVELFEFTEVEKIGRESGRGLHLPGPDTVLTINFTSGTTGNPKGVVISQANVLAGTIVARSQSTFNHRGSSGFLSFLPLAHIYERLTIHSVLTSGIPIGFFHGDVAELLDDIATYHPTIVAGVPRIWNRIAGAIRASTIEAPGIAGALSRKAYTTKLARLHETGDYHHPIWDRLWSNKIRTKTGFDQAKTFVTGSAPMARENIELIKVALGVEFVQGYGLTETMGGISVCSPGDNTAGSVGPVAITTEVKLRDLPTMNYSSSDKPFPRGEIMIRGPQVFMGYYKNEEATKGSIDEDGWFSSGDVGMIDDLGRLYVIDRVKNFFKLAQGEYVGPERIEALYQSSSGLVAQIFVEGNSLETYLVGIVGVNPEAYVQFLSHNFKMHIKPTDLEAIKKTFSRKDIRDTFLLELNVHAKDAQLKGYEKIKNVTLAIEPFSVENGTLTPTLKVKRPDAARLFKADVDAMYKEGPVEVKSKL

SEQ ID NO: 205 - protein, 723 aa, Kuraishia capsulata CBS 1993
MPSLPLPPYRAVFERAEDITRDALPFPPERNQRGIAVPGSVEPGYSAIYRSAATPDFLYDRVSPELDTYYRILKRSFEIFKDEDCVSERPQTGENSWSDKFVPRSYGEVYHDSLNFGSGLKYLLQKNEFRSGTEIPDKDYIVSIFSRNRAKWLVADISCTLFSLPNTALYDTLGPDTSTYILGLTKSPVVVAASDKISKLLDLKEADPAKLKNLIMLVAMDNLEPEVYSDLSRRAYKLNVKLYEWDQVTEAGILFPHEEVPPAPDSIYSLSFTSGTTGPPKGAILLHSGVAAGVAFTSATIDTPKQKAKLLSILPLAHIYERMTMALQLFRGGCLGFPHQPGPEHIVPNLRLFKPNLFSGVPRLFNKFEGVLKAATVHNPNASPAKRALAKRIIEWKMKQQCSKDGERGESILYDKLLNNKLRAALGFDNLYGVVTGSAPISAETIKFLKAALGVSFHQGYGLTETFAGVCVSAGLETDPGSCGVIGIATECRLKDTPELGYTSSDEGGPRGELLLRGSQVFPGYYKNEEETKKALDEDGWYHTGDIARIDSKCRIYVIDRVKNLFKLSQGEYVAPERIENIYLSSCTDFVSQIYVHGDSFSNYLVGIVGVDILGLSAFLKRKHPDLWRQVEGKTPEEILDIISSSRQLKSAILAQMNRNVSSAGLNGYEKLHNLKIGIEPLKVEDEVLTPTLKLKRNNALTKFNTDLKNLYEEGSLIKNEKL

SEQ ID NO: 206 - protein, 666 aa, Phytophthora sojae (strain P6497)
MGAGSSSELPMSQIDFDSYTGKRYTVEVPNTRDATHGPAYEVADKEPVNEDEMTLYHNFLRGCSIEHGTRPLYGRRTVDADTGKAGAFEWLTYNEVKTRVERVASGLKAVGALERQDVVGVFSKNQLEWCLVAHACDRMSYVLVPLYDTLGPDAVPFIVNHTELRVLFCGKKQFDVVMDCVKDCPTLKTIVQFEPVTEQQIQQAAAKNLELRSLEELELLGEADPKRADPPKPTDVSTLCYTSGTTGDPKGVILLQRNYAYVVRQMCKRMQIFPSDVHCSYLPLAHVFERSVLGVLQAHGASAGFYQGDLLTLMDDLVELKPTVFVSVPRLFNRVYDKITQGVAAAGGLKKILFDRALAAKLAGLPEGHKTHALWDALVFSKVRLALGGRVRLIFSGSAPLSAEVKEFMKVVFCCDVAEGYGLSETAAAVTVGSVDMPMGPHVGCPLIYGQVQLEDVPEMGYTSRDKPRPRGEILVKGPMIFSGYYKEPEKTREAIDERGWFHTGDIGCWNADGTLSIIDRKKNIFKLAQGEYVAAEKIENIYAKSKYVAQIFAYGDSLQSCLVGIVVPDPETAEAWAQEKGLTGADASAAKVATNPEFQKAVLADMARVAKEAQLRGFEFVKSVHFHPEPFSLEQGLITPTFKLKRPQLKAHFQQQINMLYEGLK

SEQ ID NO: 207 - protein, 673 aa, Dictyostelium discoideum
MINNWLAVGLLVVSGILAFNWKRKHPYGQTVEIGEKPENGGRIRRNSACADHLISFLEDDEIYTLYDSLVKSCKKYGERKCFGERKKDSNGNLGKFEWISYNTYLERCEYIQQGLCELGLKPKSKVGIFSKNRLEWLIVHSASFIQSYCVVSFYETLGVESLSYVTEHAEIGLAFCSAETLQKTLDIAKGVKVLKTIICFDSIDKEHYNIAKELGVTLYTYDEIMKKGKEANGKHKHTPPTPDTLSTIMYTSGTTGPPKGVMITHKNLTSVVCAVSDFIKVYDTDVHYSYLPYAHVLERVVILAAFHFGAAIGIFSGDISNILVEVKLLSPTLFIGVPRVFERIKTNVFKEISKKPALLRTLFNGAYNLKYLSIQHGFKLPIIEKVLDLVFFSKIKQALGGKVRVILSGSAPLSFDTEVFLRVVMCCCVLQGYGASEGCGGDACKRLDDESVGTIGPPFASNEIKLVDVPELGYDSNGEVQTGEVCLRGPSISSGYYKDEEKTREEFKDGWFHTGDIGRWNRDGSLSIVDRKKNIFKLSQGEYVAVEKIETIVVKSEYVEQVCIYGDSQKSCVIAIIHPHPESCSEWAGSKKTDKDIKEICKNQDFIKVVLDDIIKNCKKSGLHGFEIPKAIHLTPEAFSDQNNLLTPSFKLKRHEIKKYFEDEIKKLYSKLD

SEQ ID NO: 208 - protein, 670 aa, Ascaris suum
MRYWWKTSHSNYKLDAVCDINNQTRELPVSVASCKDGSRVAACLDGDHLAPFIHEDALTLYEGVRRGLRVSNNGPMLGYRKKQPDGSEPYVWLTYKEVIDRAVDFAYGLLDVGIPAGQKTFIGVYAKNRPEWVIAEQGTYNNNSVLVPLYETLGPDACTFIINQSEMSMVICDTEVKAAGLLKEKENIPTLKYLVVMEDYTNGLREAAAREGVYVYHFLDIEKRGREFVNKPALQIPSPGDVCTICYTSGTTGAPKGVMLTHGNVIAAATALTFVRNINFCETDVVISFLPLAHMFERLLECIIFQTGAHVGFFSGDIRRLPEDIKELRPTVIPLVPRVLNRIYDKVMSEVNKSFIKKAVFHFALAFKVRELRNGIVRNDSVFDKLVFNKIRDAMGGRVKLMVTGSAPLAEKVMTFARAAMGCVVLEGYGQTECAAASTLGIEADTRAGHVGIPSICNAVKLVDVPELEYYAKDMVGEVCIRGFNVFKGYYKNDELTREVLDDQGWLHTGDVGRWTENGTLQIIDRKKHIFKLSQGEYVAPEKIEGIYARSKYVAQSFVHGESLKTCLVGVIVPDPEALERVAAERFGLKDVKLKELCSNEAVRQLILEDITAVGKKAGLFSFEQVKDIFLTPDAFSVGNDLLTPTLKNKRPKLKEHFAAQLESMYSKLN

SEQ ID NO: 209 - protein, 1164 aa, Nocardia brasiliensis NBRC 14402
MERKAEVLAARRVEDLIERDAQVRAAIPDPVVTAELERADGSLAQTVARVMAGYADRPALGQRAVEFVPDENGCRRTRLLPWFDTITFGELWQRVGTVAAVWQSRAERSVRAGDFVAVLGSTGIDYTVVDLACTYSGAVPVPLQAGASPTQLAPIVREVEPKVLATDVGQLEVAVDLASAGDSVRSLLIFGLYAEDDEHCAAVESARRRLADTPVVVETIVELLASGQDRPAASLHASADPDELALLIYTSGSTGTPKGAMYTQRLLTNAWCAAGASPMPSIALSYLPMSHTMARQLLLTGLARGGTVYFAARNDMSTLFDDFALARPTLLGFVPRVCDMVLQRFQSEMARRVGADDEPTVVEQEVKTELREQFLGGRFLVASIGSAPLSADMREFMQSVLGIALIDAYGSTETGGVLMNNKVVRTAILDYKLVDVPELGYFSTDRPHPRGELLIKSRTLIPGYYKRPELNSQFFDAEGFYRTGDVMAQTGFDELVYVDRRNSVLKLSQGEFVAVSKLEAIFVGSPLVEQIYVYGSSERAYLLAVIVPVAEAIATHAGTAELKAAISESLRQIAKDAELSSYEVPRDFLLESEPFTVDNGLLAGLSKLLRPSLKERYGERLEALYRVAEAAQTQELAALRQQAGMLPVLETVSRAAQAVLGVSAAELRPDAHFTDLGGDSLAALSFSTLLQELLGVQVPVGVIASSANDLRRIANYAVAERSAGSLRPTSTGVHGTGSQLRAIDLRLDKFIDPSTLAAATTLPRAGEPRTVLLTGANGYLGRFLCLEWLQRLHHSGGTLICVVRGIDAVAARERLDEVFDSGDPELLHRYRELAEGTLEVLCGDISEPGLGLSERDWRRLADTVELIVHAAALVNHVLPYGQLFGPNVVGTAEIIRLAMTTRIKPVTYLSTVAVAAQVAPEQFTEDGDIREISAVRSLDEGYADGYGTSKWAGEVLLREAYDLCGLPVAVFRSDMILAHSRFAGQLNVSDMFTRLVLSVLATGVAPKSFYETDRMGNRQRAHYDGLPVDFTAQAITVLGSQVVSGFETFDVLNPHDDGLSLDEFVDWLIAAGHSIDRIDGYAEWLSRFGTALRVLSERQRQHSVLPLLHAYRRAAVPIPGAALPAKKFQAAVQDAQLGPGRDIPHLTPDLIEKYVSDLKLRNLL

SEQ ID NO: 210 - protein, 659 aa, Rhizopus microsporus
MPPAFDPPYSVPVPGSEKKEGETVPFRHFKFADKLVDHPEGVFTAWDIFVHGYDSAGDKPFMGTRRIEDGVAKEYVWQNYPEVRTRIENFGKGMLHLGLKRQHAIGVYSVNRPEWTMTEIASYRQAFMIVALYDTLGAEAMEYIINQTSMEYIVLSADKLDNIIRLKSQIATISTAIVMDDEVDDAKKAEAEAAGIKVYTFRQVETMGSEITSESDLPKPEDIATICYTSGTTGVPKGAVITQANCVAAISAIAALGDKGTFADVNSDDIYISYLPLAHVFERVAQGIHLFRGAAIGYYQGDTLKLLDDIAELRPTVFCSVPRLFNRIYDKVLAGVKAKGGVSAYLFNTAFQSKKRHLSKTVHHWLWDRVVFTQIRQKLGGRLRFILSGSAPVSPDVMDFMRICFSAKVFEGYGQTENFCGGALTITDDNTSGVVGAPFPCSEIKLVDVPEMEYFSTDKPFPRGEICIRGTSIMQGYYQLPEKTAEAIDKDGWLHTGDIGQFDSANRLVIIDRLKNIFKLSQGEYIAPEKIEGVYQKHELVAQAFIYGDSMQSSLVGIIVPDKDAFSAWAKEHFPTVEDPYASDEVKKALLKELTAYGKENDLKGFEQMRSVYLTPNEFSIENDLLTPTFKLRRENAKKVYESQIEIMYASLSNGRAFN

SEQ ID NO: 211 - protein, 669 aa, Theileria parva
MNHLYSVALEGTEEEGYTPVYRNPDYKDRLLSCEDYFDGKIQTGWDIFNRGLTLSRNKPFLGSRVKNADGTFGEFKFMTYGEVEDQIKHFGSGLLNLDKFKEVFVKEENQMVKMLGIYSQNTVEWLITEQVCNGYNLTLVPLYDTLGEESLLYIINVTKLNVIVCDYKCSLKLLDLLPKSNGSVSLVVVTGVDELPDQVTAKSQSLSSVTFKTYQEVVNFGKEDPLAFTPCTKDSIGTISYTSGVSGIPKGVIVKHFQHASLVVIVNRIVCDLEKTQLENPKVHLSYLPLSHMFERLYIGTSIIEGSVIGLFSGDVKNILEDIKALRPNVFPSVPRLYMRIHDKIFSTVSQKSFLIRSLFGLGLSRKLKKIRKTGVVTHRFWDKILFNKFNTLLGGRVNWMLTGSAPLSPKIFDNIRALFSIPLVSGYGLTETCAGAFHTERYEPDSTHVGGPVPCMEFRLKSLPDYNYYTTDKNPKGELLLRGNNIVTSYFSDDVTNKESFDENKWFLTGDIAELLPNGAIRIIDRRKNIFKLSQGEYISPEKIESILNTAPILCQSYVTGKSHFLNPVAVVVPDELELELWSKRYGLANLDRKEQCEVKQLKEFIAKEIEKVFENSDVKGFEKIKNFYVEHELFSIENNLLTTTSKLKRYNLSKKYAEQIDRLNDES

SEQ ID NO: 212 - protein, 376 aa, Anisakis simplex
MYERLLHCIGYQVGLRFGFFGGDVNRLIDDIKELHPTVIPLVPRVLNRFHDTVMAKVNKSFLKRIIFNLALAFKYRELSRSIIRNDSLVDRYVFKRVREELGGRARFSMIGSAPVHGDILRFSRAVLGYVIVEGYGATECAAGTSAVIEADPITEHIGIPLACAAIKLVDVPELGYYAKDQAGEICYRGAHVFKGYFKNDEGTKEVLDADGWLHSGDIGRWTERGTLKIVDRKKHIFKLQQGEYIAPEKIEAVYDRSEYVVQSFVYGESLKTCLVAIIVPDQEIVLRDAKQKLDLAETDFAKLCRNDAVKKMILNDLTIVGRKAGLNSFEQVKDIYLSVERFTIANDLLTPTMKNKRPQIKSHFMKELNEMYSKLK

SEQ ID NO: 213 - protein, 642 aa, Helobdella robusta
MRVSNNGPFLGHRCRFTKQYVWQTYEEIFELCQDFGSALIYKGLKPEDSTVIGIYSHNCVEWNITSETCSMFSMALVPLYDTLGPEACQYIINQTEMTTVVCEGWLKANLILNGLKQAESRTATPLKRLIIITNKDFHMSLKDSVRVSKHFSSSPDLANFADADSLSKNVLETAEKFGVEIPPTPSTINLISYTSGTTGDPKGVVLTHEAVICNISGLLAYDQHHKLFPKCGDFHLSYLPAAHGFERMNQIILMINGGQIGFSSGDILLLLDDIAALRPTIFMCVPRVLNRVYEKVMSNLENKPIKRWLFNFGMQRKLNLLKRGIITKNTIWDKLMFHKIQTLFGGRLEVCISGSAPLSDVVMDFCRGTFGCFVYEGYGQTELCAATMLTLPYEHDTVVVGPPLPNCHIKLIDIPDLDYKAINNMGEICIKSFCRMREYFKEPIKTRETLDEDSYIHTGDVGMWLPNGNLRIIDRRKHVFKLAQGEYVAPEKIENIYAMSPLICQVFVDGNSLQFCPLAVVVPDEDALKRLAERDSRTSKTICPIKICNMEQFCKNEEIRKMIHADMLQRGKKAGLKGFEQVKDIHLHPEKFSIENGLLTPTMKTKRPILRKKFQNIFVEMYEKLNRNVVSTNITTHPLQNL

SEQ ID NO: 214 - protein, 1187 aa, Mycobacterium lepromatosis
MSTTNTQEEQLARRVDYLTANDPQFAAAKPDPAVVAALAQPGLRLPQIIQTTLDGYAERPALGQRVVEFIKDPKTGRTSIELLPCFETITYRELSDRVGALARAWIHDLLHAGDRVCVLGFNSVDYAIIDMALGVISAVAVPLQTSAAITQLQPIVIETEPRVIAASVNQLPDTVELILSGPAPAKLVVFDYHPEADEQRDAVATARERLVDNNVVVESLIEVLDRGKTLPATPIPVADDSDDPLALLIYTSGSTGAPKGAMYPQSNVGKMWRRSDGNWFRSTAASITLNFMPMSHVMGHGILYGTLGNGGTAYFAARSDLSTLLEDLKLVRPTELNFVPRIWETLYDECQHAVDRRLTNSGSADRAAIEAEVMDEQRQSLLGGRYIAAMTGSAPTSPELKHGVESLLEMHLLEGYGSTEAGMVLFDGEVQRPPVIDYKLVDVPDLGYFSTDQPYPRGELLLKTQNMFPGYYKRPEVTATVFDGDGYYQTGDIVAEVGPARLVYVDRRNNVLKLAQGQFVTVAQLEAAFSNSPLVRQIYIYGNSAHPYLLAVVVPTEDALATNDIEALKPLIIDSLQEVAKEAELQSYEVPRDLIIETTPFSLENGLLTGIRKLAWPKLKQHYGARLEQLYADLAEGQTNALHALRQSGAEAPVLQTVSRAAGTILGAATTDLPSNAHFTDLGGDSLSALTFSNLLRELFNIDVPVGVIVSPVNDLAAIADYIESEQQGTKRPTFTAIHGRDAGEVHASDLTLDKFIDVSTLTAAPMLAQPDAEVRTVLLTGATGFLGRYLALKWLERMDLVDGKVIALVRAKSNEEARARLGKTFDSGDPKLLAHYQELAADHLEVIAGDKGEVELELDRQTWRRLADTVDLIVDPAALVNHVLPYSELFGPNALGTAELIRIALTSKQKPYIYVSTIGVGDQIEPAKFTEDSDIRVTSPTRKINDNYANGYGNSKWAGEVLLREAHELCGLPVAVFRCDMILADTSYAGQLNVPDMFTRMMLSLAATGIAPGSFYELDAESNRQRAHYDGLPVEFIAEAISTLGAQSLHGRDGFATYHVMNPHDDGIGMDEFVDWLIDAGCPIQRINDYDEWLRRFEISLRALPERQRHNSLLPLLHNYQKPEKPLNGSLAPTDRFRTAVQESKIVQDKDIPHISSAIIGKYVSDLQLLGLLRRQADRSPARVPS

SEQ ID NO: 215 - protein, 704 aa, Schizopora paradoxa
MASTLLQDVSPAPPLMISPLEIPLPEPVDFSKQAVEVPGTRRPGQTGHYQNAVWGFKAFPEEGPVYTLPDVFELGLSLEKNGQTSNKPFLGHRPVISAEPLKFASDYVWSTYAEADERRQNVGSALEKYFRDGTLGGGEYQTVGIWSQNRAEWQIVELACHAYGKVSVSLYDTLGKDSVEYIIEHAHLTVIFVTSQHIPLLLAMASKVPMLKLIVSVDELSSEAKRIMGIWSRTANVQVMELSELEQFGKANRLNMARPIGKSLATICYTSGTTSGPKGVLLTHSNLVSSVKSNLRASHFGEKGGIMMSYLPLAHIYERITELCTMALGGQIGFFTGDPLRLLEDASILKPNFFPSVPRVLNRVYQSAMLAGQTPGLKGYLFRTAMDAKLKKLHETGDNTHMLWDRLVFRKIQALLGGNVELVSCGSAPISVDVMDFLKIAFSCDVIEGYGMTENCGTCTRCWPNDPSSSGTVGAPQPCNEIKLVDVPSMNYTSNDKPNPRGEVCLRGNNCFSTYYKDEKNTRETVDEEGWLHTGDVGEIDSAGRLKIIDRIKNIMKLAQGEYVALEKIENVYGLHPLVAQLYVHGESLQDHLVGVIVPDPTQFAILCNSIRGTKIGANDSAELATAARDPAVAQAVLREITHEAKKAALKGFEMIKKIHLTTVPFSTENGLLTPTFKVRRKDCSIYFKEELAALYAQPTSMLK

What is claimed is:

1. A method for biosynthesizing a difunctional product in a recombinant *Escherichia* host having a BioH deficient background, said method comprising:
enzymatically synthesizing an aliphatic carbon chain backbone having nine, eleven, thirteen, fifteen, seventeen, or nineteen carbon atoms from (i) acetyl-CoA and propanedioyl-CoA via three or more cycles of methyl ester shielded carbon chain elongation or (ii) propanedioyl-[acp] via three or more cycles of methyl ester shielded carbon chain elongation, wherein:
a polypeptide encoded by an exogenous gene and having the activity of a S-adenosyl-L-methionine (SAM)-dependent methyltransferase under EC 2.1.1.197 converts propanedioyl-CoA to propanedioyl-CoA methyl ester or converts propanedioyl-[acp] to propanedioyl-[acp] methyl ester before said three or more cycles of methyl ester shielded carbon chain elongation; and
each of said three or more methyl ester shielded cycles of carbon chain elongation comprises using genes encoding (i) a polypeptide having the activity of a β-ketoacyl-[acp] synthase classified under EC 2.3.1.41, EC 2.3.1.179, or EC 2.3.1.180 or a β-ketothiolase classified under EC 2.3.1.16, (ii) a polypeptide having the activity of a 3-oxoacyl-[acp] reductase classified under EC 1.1.1.100, an acetoacetyl-CoA reductase classified under EC 1.1.1.36, a 3-hydroxyacyl-CoA dehydrogenase classified under EC 1.1.1.35, EC 1.1.1.36, or EC 1.1.1.157, or a 3-hydroxybutyryl-CoA dehydrogenase classified under EC 1.1.1.157, (iii) an enoyl-CoA hydratase classified under EC 4.2.1.17, EC 4.2.1.119, or EC 4.2.1.150 or a 3-hydroxyacyl-[acp] dehydratase classified under EC 4.2.1.59, and (iv) an enoyl-[acp] reductase classified under EC 1.3.1.9 or EC 1.3.1.10 or a trans-2-enoyl-CoA reductase classified under EC 1.3.1.8, EC 1.3.1.38, or EC 1.3.1.44;
enzymatically forming a first terminal functional group selected from carboxyl, amine, formyl, and hydroxyl groups in said aliphatic carbon chain backbone while maintaining said methyl ester shield for at least one further enzymatic step;
enzymatically forming a second terminal functional group selected from carboxyl, amine, formyl, and hydroxyl groups in said aliphatic carbon chain backbone, thereby forming said difunctional product, wherein:
a carboxyl terminal group is formed by a polypeptide having the activity of a thioesterase classified under EC 3.1.1.2, EC 3.1.1.5, 3.1.2.14, EC 3.1.2.21, or EC 3.1.2.27, an aldehyde dehydrogenase classified under EC 1.2.1.3, a 6-oxohexanoate dehydrogenase classified under EC 1.2.1.63, a CoA-transferase classified under EC 2.8.3.12, or a reversible CoA-ligase classified under EC 6.2.1.5;
an amine terminal group is formed by a polypeptide having the activity of an aminotransferase classified under EC 2.6.1.11, EC 2.6.1.13, EC 2.6.1.18, EC 2.6.1.19, EC 2.6.1.29, EC 2.6.1.48, EC 2.6.1.82, EC 4.1.1.64, or EC 5.4.3.8 or a deacetylase classified under EC 3.5.1.62;
a formyl terminal group is formed by a polypeptide having the activity of an acetylating aldehyde dehydrogenase classified under EC 1.2.1.10, a succinate semialdehyde dehydrogenase classified under EC 1.2.1.76, or an oxoglutarate dehydrogenase classified under EC 1.2.1.52; or
a hydroxyl terminal group is formed by a polypeptide having the activity of an alcohol dehydrogenase classified under EC 1.1.1.1, EC 1.1.1.2, EC 1.1.1.21, EC 1.1.1.61, EC 1.1.1.184, or EC 1.1.1.258.

2. The method of claim 1, wherein said aliphatic carbon chain backbone is i) nonanedioyl-[acp] methyl ester or nonanedioyl-CoA methyl ester, ii) undecanedioyl-[acp] methyl ester or undecanedioyl-CoA methyl ester, iii) tridecanedioyl-[acp]methyl ester or tridecanedioyl-CoA methyl ester, iv) pentadecanedioyl-[acp] methyl ester or pentadecanedioyl-CoA methyl ester, v) heptadecanedioyl-[acp] methyl ester or heptadecanedioyl-CoA methyl ester, or vi) nonadecanedioyl-[acp] methyl ester or nonadecanedioyl-CoA methyl ester.

3. The method of claim 1, wherein:
said at least one further enzymatic step comprises the enzymatic conversion of said aliphatic carbon chain backbone to a monomethyl carboxylate using a polypeptide having the activity of a thioesterase classified under EC 3.1.1.2, EC 3.1.1.5, EC 3.1.2.14, EC 3.1.2.21, or EC 3.1.2.27; and
said at least one further enzymatic step also produces holo-ACP or holo-CoA.

4. The method of claim 3, wherein:
said at least one further enzymatic step comprises the enzymatic conversion of nonanedioyl-[acp] methyl ester to monomethyl nonanedioate or nonanedioyl-CoA methyl ester to monomethyl nonanedioate;
said at least one further enzymatic step comprises the enzymatic conversion of undecanedioyl-[acp] methyl ester to monomethyl undecanedioate or undecanedioyl-CoA methyl ester to monomethyl undecanedioate;
said at least one further enzymatic step comprises the enzymatic conversion of tridecanedioyl-[acp] methyl ester to monomethyl tridecanedioate or tridecanedioyl-CoA methyl ester to monomethyl tridecanedioate;
said at least one further enzymatic step comprises the enzymatic conversion of pentadecanedioyl-[acp] methyl ester to monomethyl pentadecanedioate or pentadecanedioyl-CoA methyl ester to monomethyl pentadecanedioate;

said at least one further enzymatic step comprises the enzymatic conversion of heptadecanedioyl-[acp] methyl ester to monomethyl heptadecanedioate or heptadecanedioyl-CoA methyl ester to monomethyl heptadecanedioate; or said at least one further enzymatic step comprises the enzymatic conversion of nonadecanedioyl-[acp] methyl ester to monomethyl nonadecanedioate or nonadecanedioyl-CoA methyl ester to monomethyl nonadecanedioate.

5. The method of claim 1, wherein said at least one further enzymatic step further comprises the enzymatic conversion of said monomethyl carboxylate to a monomethyl carboxylate semialdehyde using a polypeptide having the activity of a carboxylate reductase classified under EC 1.2.99.6.

6. The method of claim 5, wherein:
said at least one further enzymatic step comprises the enzymatic conversion of monomethyl nonanedioate to methyl 9-oxononanoate;
said at least one further enzymatic step comprises the enzymatic conversion of monomethyl undecanedioate to methyl 11-oxoundecanoate;
said at least one further enzymatic step comprises the enzymatic conversion of monomethyl tridecanedioate to methyl 13-oxotridecanoate;
said at least one further enzymatic step comprises the enzymatic conversion of monomethyl pentadecanedioate to methyl 15-oxopentadecanoate;
said at least one further enzymatic step comprises the enzymatic conversion of monomethyl heptadecanedioate to methyl 17-oxoheptadecanoate; or
said at least one further enzymatic step comprises the enzymatic conversion of monomethyl nonadecanedioate to methyl 19-oxononadecanoate.

7. The method of claim 5, wherein said at least one further enzymatic step further comprises the enzymatic conversion of said monomethyl carboxylate semialdehyde to a monomethyl aminocarboxylate using a polypeptide having the activity of an aminotransferase classified under EC 2.6.1.11, EC 2.6.1.13, EC 2.6.1.18, EC 2.6.1.19, EC 2.6.1.29, EC 2.6.1.48, EC 2.6.1.82, EC 4.1.1.64, or EC 5.4.3.8.

8. The method of claim 7, wherein:
said at least one further enzymatic step comprises the enzymatic conversion of methyl 9-oxononanoate to monomethyl 9-aminononanoate;
said at least one further enzymatic step comprises the enzymatic conversion of methyl 11-oxoundecanoate to monomethyl 11-aminoundecanoate;
said at least one further enzymatic step comprises the enzymatic conversion of methyl 13-oxotridecanoate to monomethyl 13-aminotridecanoate;
said at least one further enzymatic step comprises the enzymatic conversion of methyl 15-oxopentadecanoate to monomethyl 15-aminopentadecanoate;
said at least one further enzymatic step comprises the enzymatic conversion of methyl 17-oxoheptadecanoate to monomethyl 17-aminoheptadecanoate; or
said at least one further enzymatic step comprises the enzymatic conversion of methyl 19-oxononadecanoate to monomethyl 19-aminononadecanoate.

9. The method of claim 1, wherein:
said at least one further enzymatic step comprises the enzymatic conversion of said aliphatic carbon chain backbone to a monomethyl carboxylate semialdehyde using a polypeptide having the activity of an acetylating aldehyde dehydrogenase classified under EC 1.2.1.10; and said at least one further enzymatic step also produces holo-ACP or holo-CoA.

10. The method of claim 9, wherein:
said at least one further enzymatic step comprises the enzymatic conversion of nonanedioyl-[acp] methyl ester to methyl 9-oxononanoate or nonanedioyl-CoA methyl ester to methyl 9-oxononanoate;
said at least one further enzymatic step comprises the enzymatic conversion of undecanedioyl-[acp] methyl ester to methyl 11-oxoundecanoate or undecanedioyl-CoA methyl ester to methyl 11-oxoundecanoate;
said at least one further enzymatic step comprises the enzymatic conversion of tridecanedioyl-[acp] methyl ester to methyl 13-oxotridecanoate or tridecanedioyl-CoA methyl ester to methyl 13-oxotridecanoate;
said at least one further enzymatic step comprises the enzymatic conversion of pentadecanedioyl-[acp] methyl ester to methyl 15-oxopentadecanoate or pentadecanedioyl-CoA methyl ester to methyl 15-oxopentadecanoate;
said at least one further enzymatic step comprises the enzymatic conversion of heptadecanedioyl-[acp] methyl ester to methyl 17-oxoheptadecanoate or heptadecanedioyl-CoA methyl ester to methyl 17-oxoheptadecanoate; or
said at least one further enzymatic step comprises the enzymatic conversion of nonadecanedioyl-[acp] methyl ester to methyl 19-oxononadecanoate or nonadecanedioyl-CoA methyl ester to methyl 19-oxononadecanoate.

11. The method of claim 3, wherein a second terminal functional group is formed by the enzymatic conversion of said monomethyl carboxylate to a dicarboxylic acid using a polypeptide having the activity of an esterase classified under EC 3.1.1.1.

12. The method of claim 11, wherein said dicarboxylic acid is nonanedioic acid, undecanedioic acid, tridecanedioic acid, pentadecanedioic acid, heptadecanedioic acid, or nonadecanedioic acid.

13. The method of claim 5, wherein a second terminal functional group is formed by the enzymatic conversion of said monomethyl carboxylate semialdehyde to a carboxylate semialdehyde using a polypeptide having the activity of an esterase classified under EC 3.1.1.1.

14. The method of claim 13, wherein-said carboxylate semialdehyde is 9-oxononanoate, 11-oxoundecanoate, 13-oxotridecanoate, 15-oxopentadecanoate, 17-oxoheptadecanoate, or 19-oxononadecanoate.

15. The method of claim 7, wherein a second terminal group is formed by the enzymatic conversion of said monomethyl aminocarboxylate to an aminocarboxylate using a polypeptide having the activity of an esterase classified under EC 3.1.1.1.

16. The method of claim 15, wherein said aminocarboxylate is 9-aminononanoate, 11-aminoundecanoate, 13-aminotridecanoate, 15-aminopentadecanoate, 17-aminoheptadecanoate, or 19-aminononadecanoate.

17. The method of claim 13, further comprising enzymatically converting said carboxylate semialdehyde to an aminocarboxylate using a polypeptide having the activity of an aminotransferase classified under EC 2.6.1.11, EC 2.6.1.13, EC 2.6.1.18, EC 2.6.1.19, EC 2.6.1.29, EC 2.6.1.48, EC 2.6.1.82, EC 4.1.1.64, or EC 5.4.3.8.

18. The method of claim 17, wherein said aminocarboxylate is 9-aminononanoate, 11-aminoundecanoate, 13-aminotridecanoate, 15-aminopentadecanoate, 17-aminoheptadecanoate, or 19-aminononadecanoate.

19. The method of claim 13, further comprising enzymatically converting said carboxylate semialdehyde to a hydroxycarboxylate using a polypeptide having the activity of an alcohol dehydrogenase classified under EC 1.1.1.1, EC 1.1.1.2, EC 1.1.1.21, EC 1.1.1.61, EC 1.1.1.184, or EC 1.1.1.258.

20. The method of claim 19, wherein said hydroxycarboxylate is 9-hydroxynonanoate, 11-hydroxyundecanoate, 13-hydroxytridecanoate, 15-hydroxypentadecanoate, 17-hydroxyheptadecanoate, or 19-hydroxynonadecanoate.

21. The method of claim 13, further comprising enzymatically converting said carboxylate semialdehyde to a diamine, wherein said carboxylate semialdehyde is enzymatically converted to said diamine in one or more steps involving a polypeptide having the activity of a carboxylate reductase classified under EC 1.2.99.6 and a polypeptide having the activity of an aminotransferase classified under EC 2.6.1.11, EC 2.6.1.13, EC 2.6.1.18, EC 2.6.1.19, EC 2.6.1.29, EC 2.6.1.48, EC 2.6.1.82, EC 4.1.1.64, or EC 5.4.3.8.

22. The method of claim 21, wherein said diamine is nonane-1,9-diamine, undecane- 1,11-diamine, tridecane-1,13-diamine, pentadecane- 1,15-diamine, heptadecane-1,17-diamine, or nonadecane-1,19-diamine.

23. The method of claim 19, further comprising enzymatic converting said hydroxycarboxylate to a diol, wherein said hydroxycarboxylate is enzymatically converted to said diol in one or more steps involving a polypeptide having the activity of a carboxylate reductase classified under EC 1.2.99.6 and a polypeptide having the activity of an alcohol dehydrogenase classified under EC 1.1.1.1, EC 1.1.1.2, EC 1.1.1.21, EC 1.1.1.61, EC 1.1.1.184, or EC 1.1.1.258.

24. The method of claim 23, wherein said diol is 1,9-nonanediol, 1,11-undecanediol, 1,13-tridecanediol, 1,15-pentadecanediol, 1,17-heptadecanediol, or 1,19-nonadecanediol.

25. The method of claim 1, wherein:
said difunctional product comprises a terminal amine and a terminal carboxyl group;
said difunctional product comprises a terminal formyl group;
said difunctional product comprises a terminal hydroxyl group and a terminal carboxyl group;
said two terminal functional groups are amine groups; or
said two terminal functional groups are hydroxyl groups.

26. The method of claim 1, wherein said method is performed in said recombinant *Escherichia* host by fermentation.

27. The method of claim 26, wherein:
said recombinant *Escherichia* host is subjected to a cultivation strategy under aerobic, anaerobic, micro-aerobic, or mixed oxygen/denitrification cultivation conditions;
said recombinant *Escherichia* host is cultured under conditions of nutrient limitation;
said recombinant *Escherichia* host is retained using a ceramic hollow fiber membrane to maintain a high cell density during fermentation; or
said recombinant *Escherichia* host's tolerance to high concentrations of said difunctional product is improved through continuous cultivation in a selective environment.

28. The method of claim 26, wherein:
the principal carbon source fed to the fermentation is monosaccharides, disaccharides, lignocellulose, hemicellulose, cellulose, lignin, levulinic acid, formic acid, triglycerides, glycerol, fatty acids, agricultural waste, condensed distillers' solubles, municipal waste, natural gas, syngas, $CO_2/H_2$, methanol, ethanol, benzoate, non-volatile residue (NVR) caustic wash waste stream from cyclohexane oxidation processes, or terephthalic acid/isophthalic acid mixture waste streams; or
the principal carbon source fed to the fermentation derives from monosaccharides, disaccharides, lignocellulose, hemicellulose, cellulose, lignin, levulinic acid, formic acid, triglycerides, glycerol, fatty acids, agricultural waste, condensed distillers' solubles, municipal waste, natural gas, syngas, $CO_2/H_2$, methanol, ethanol, benzoate, non-volatile residue (NVR) caustic wash waste stream from cyclohexane oxidation processes, or terephthalic acid/isophthalic acid mixture waste streams.

29. The method of claim 28, wherein:
the principal carbon feedstock is not glucose; and
the principal carbon feedstock does not derive from glucose.

30. The method of claim 26, wherein said recombinant prokaryote host is not *Escherichia coli*.

* * * * *

UNITED STATES PATENT AND TRADEMARK OFFICE
CERTIFICATE OF CORRECTION

PATENT NO. : 10,801,046 B2  
APPLICATION NO. : 15/659505  
DATED : October 13, 2020  
INVENTOR(S) : Alexander Brett Foster et al.

Page 1 of 1

It is certified that error appears in the above-identified patent and that said Letters Patent is hereby corrected as shown below:

In the Claims

Claim 1, Column 165, Line 43, "3-hydroxyhutyryl-CoA" should read --3-hydroxybutyryl-CoA--.

Claim 5, Column 167, Line 11, "The method of claim 1" should read --The method of claim 3--.

Claim 14, Column 168, Line 45, "wherein-said" should read --wherein said--.

Signed and Sealed this  
Nineteenth Day of January, 2021

Andrei Iancu  
*Director of the United States Patent and Trademark Office*